United States Patent 11,464,842 (COMPOSITIONS AND METHOD FOR OPTIMIZED PEPTIDE VACCINES USING RESIDUE OPTIMIZATION) - sequence listing, part 39

SEQ ID NO: 330623 - protein, 21 aa, Artificial Sequence
  Description of Artificial Sequence: Synthetic peptide
  Seed: LDGTATLRLVKRQVPLDCVLY (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCVLY

SEQ ID NO: 330624 - protein, 21 aa, Artificial Sequence
  Description of Artificial Sequence: Synthetic peptide
  Seed: LDGTATLRLVKRQVPLDCVLY (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCVLY

SEQ ID NO: 330625 - protein, 21 aa, Artificial Sequence
  Description of Artificial Sequence: Synthetic peptide
  Seed: LDGTATLRLVKRQVPLDCVLY (PMEL_HUMAN)
  Core: RLVKRQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLXLVXRXVPXDCVLY

SEQ ID NO: 330626 - protein, 21 aa, Artificial Sequence
  Description of Artificial Sequence: Synthetic peptide
  Seed: LDGTATLRLVKRQVPLDCVLY (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCVLY

SEQ ID NO: 330627 - protein, 21 aa, Artificial Sequence
  Description of Artificial Sequence: Synthetic peptide
  Seed: LDGTATLRLVKRQVPLDCVLY (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXVLY

SEQ ID NO: 330628 - protein, 21 aa, Artificial Sequence
  Description of Artificial Sequence: Synthetic peptide
  Seed: LDGTATLRLVKRQVPLDCVLY (PMEL_HUMAN)
  Core: KRQVPLDCV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVXRQXPXDCXLY

SEQ ID NO: 330629 - protein, 22 aa, Artificial Sequence
  Description of Artificial Sequence: Synthetic peptide
  Seed: LDGTATLRLVKRQVPLDCVLYR (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCVLYR

SEQ ID NO: 330630 - protein, 22 aa, Artificial Sequence
  Description of Artificial Sequence: Synthetic peptide
  Seed: LDGTATLRLVKRQVPLDCVLYR (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXPLDCVLYR

SEQ ID NO: 330631 - protein, 22 aa, Artificial Sequence
  Description of Artificial Sequence: Synthetic peptide
  Seed: LDGTATLRLVKRQVPLDCVLYR (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCVLYR

SEQ ID NO: 330632 - protein, 22 aa, Artificial Sequence
  Description of Artificial Sequence: Synthetic peptide
  Seed: LDGTATLRLVKRQVPLDCVLYR (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCVLYR

SEQ ID NO: 330633 - protein, 22 aa, Artificial Sequence
  Description of Artificial Sequence: Synthetic peptide
  Seed: LDGTATLRLVKRQVPLDCVLYR (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXVLYR

SEQ ID NO: 330634 - protein, 22 aa, Artificial Sequence
  Description of Artificial Sequence: Synthetic peptide
  Seed: LDGTATLRLVKRQVPLDCVLYR (PMEL_HUMAN)
  Core: KRQVPLDCV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVXRQXPXDCXLYR

SEQ ID NO: 330635 - protein, 23 aa, Artificial Sequence
  Description of Artificial Sequence: Synthetic peptide
  Seed: LDGTATLRLVKRQVPLDCVLYRY (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCVLYRY

SEQ ID NO: 330636 - protein, 23 aa, Artificial Sequence
  Description of Artificial Sequence: Synthetic peptide
  Seed: LDGTATLRLVKRQVPLDCVLYRY (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXPLDCVLYRY

SEQ ID NO: 330637 - protein, 23 aa, Artificial Sequence
  Description of Artificial Sequence: Synthetic peptide
  Seed: LDGTATLRLVKRQVPLDCVLYRY (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCVLYRY

SEQ ID NO: 330638 - protein, 23 aa, Artificial Sequence
  Description of Artificial Sequence: Synthetic peptide
  Seed: LDGTATLRLVKRQVPLDCVLYRY (PMEL_HUMAN)
  Core: RLVKRQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLXLVXRXVPXDCVLYRY

SEQ ID NO: 330639 - protein, 23 aa, Artificial Sequence
  Description of Artificial Sequence: Synthetic peptide
  Seed: LDGTATLRLVKRQVPLDCVLYRY (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCVLYRY

SEQ ID NO: 330640 - protein, 23 aa, Artificial Sequence
  Description of Artificial Sequence: Synthetic peptide
  Seed: LDGTATLRLVKRQVPLDCVLYRY (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXVLYRY

SEQ ID NO: 330641 - protein, 23 aa, Artificial Sequence
  Description of Artificial Sequence: Synthetic peptide
  Seed: LDGTATLRLVKRQVPLDCVLYRY (PMEL_HUMAN)
  Core: KRQVPLDCV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVXRQXPXDCXLYRY

SEQ ID NO: 330642 - protein, 23 aa, Artificial Sequence
  Description of Artificial Sequence: Synthetic peptide
  Seed: LDGTATLRLVKRQVPLDCVLYRY (PMEL_HUMAN)
  Core: QVPLDCVLY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRXVPXDXVLXRY

SEQ ID NO: 330643 - protein, 23 aa, Artificial Sequence
  Description of Artificial Sequence: Synthetic peptide
  Seed: LDGTATLRLVKRQVPLDCVLYRY (PMEL_HUMAN)
  Core: VPLDCVLYR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRQXPLXCXLYXY

SEQ ID NO: 330644 - protein, 24 aa, Artificial Sequence
  Description of Artificial Sequence: Synthetic peptide
  Seed: LDGTATLRLVKRQVPLDCVLYRYG (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCVLYRYG

SEQ ID NO: 330645 - protein, 24 aa, Artificial Sequence
  Description of Artificial Sequence: Synthetic peptide
  Seed: LDGTATLRLVKRQVPLDCVLYRYG (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXPLDCVLYRYG

SEQ ID NO: 330646 - protein, 24 aa, Artificial Sequence
  Description of Artificial Sequence: Synthetic peptide
  Seed: LDGTATLRLVKRQVPLDCVLYRYG (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCVLYRYG

SEQ ID NO: 330647 - protein, 24 aa, Artificial Sequence
  Description of Artificial Sequence: Synthetic peptide
  Seed: LDGTATLRLVKRQVPLDCVLYRYG (PMEL_HUMAN)
  Core: RLVKRQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLXLVXRXVPXDCVLYRYG

SEQ ID NO: 330648 - protein, 24 aa, Artificial Sequence
  Description of Artificial Sequence: Synthetic peptide
  Seed: LDGTATLRLVKRQVPLDCVLYRYG (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCVLYRYG

SEQ ID NO: 330649 - protein, 24 aa, Artificial Sequence
  Description of Artificial Sequence: Synthetic peptide
  Seed: LDGTATLRLVKRQVPLDCVLYRYG (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXVLYRYG

SEQ ID NO: 330650 - protein, 24 aa, Artificial Sequence
  Description of Artificial Sequence: Synthetic peptide
  Seed: LDGTATLRLVKRQVPLDCVLYRYG (PMEL_HUMAN)
  Core: KRQVPLDCV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVXRQXPXDCXLYRYG

SEQ ID NO: 330651 - protein, 24 aa, Artificial Sequence
  Description of Artificial Sequence: Synthetic peptide
  Seed: LDGTATLRLVKRQVPLDCVLYRYG (PMEL_HUMAN)
  Core: QVPLDCVLY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRXVPXDXVLXRYG

SEQ ID NO: 330652 - protein, 24 aa, Artificial Sequence
  Description of Artificial Sequence: Synthetic peptide
  Seed: LDGTATLRLVKRQVPLDCVLYRYG (PMEL_HUMAN)
  Core: VPLDCVLYR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRQXPLXCXLYXYG

SEQ ID NO: 330653 - protein, 25 aa, Artificial Sequence
  Description of Artificial Sequence: Synthetic peptide
  Seed: LDGTATLRLVKRQVPLDCVLYRYGS (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCVLYRYGS

SEQ ID NO: 330654 - protein, 25 aa, Artificial Sequence
  Description of Artificial Sequence: Synthetic peptide
  Seed: LDGTATLRLVKRQVPLDCVLYRYGS (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXPLDCVLYRYGS

SEQ ID NO: 330655 - protein, 25 aa, Artificial Sequence
  Description of Artificial Sequence: Synthetic peptide
  Seed: LDGTATLRLVKRQVPLDCVLYRYGS (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCVLYRYGS

SEQ ID NO: 330656 - protein, 25 aa, Artificial Sequence
  Description of Artificial Sequence: Synthetic peptide
  Seed: LDGTATLRLVKRQVPLDCVLYRYGS (PMEL_HUMAN)
  Core: RLVKRQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLXLVXRXVPXDCVLYRYGS

SEQ ID NO: 330657 - protein, 25 aa, Artificial Sequence
  Description of Artificial Sequence: Synthetic peptide
  Seed: LDGTATLRLVKRQVPLDCVLYRYGS (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCVLYRYGS

SEQ ID NO: 330658 - protein, 25 aa, Artificial Sequence
  Description of Artificial Sequence: Synthetic peptide
  Seed: LDGTATLRLVKRQVPLDCVLYRYGS (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXVLYRYGS

SEQ ID NO: 330659 - protein, 25 aa, Artificial Sequence
  Description of Artificial Sequence: Synthetic peptide
  Seed: LDGTATLRLVKRQVPLDCVLYRYGS (PMEL_HUMAN)
  Core: KRQVPLDCV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVXRQXPXDCXLYRYGS

SEQ ID NO: 330660 - protein, 25 aa, Artificial Sequence
  Description of Artificial Sequence: Synthetic peptide
  Seed: LDGTATLRLVKRQVPLDCVLYRYGS (PMEL_HUMAN)
  Core: QVPLDCVLY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRXVPXDXVLXRYGS

SEQ ID NO: 330661 - protein, 25 aa, Artificial Sequence
  Description of Artificial Sequence: Synthetic peptide
  Seed: LDGTATLRLVKRQVPLDCVLYRYGS (PMEL_HUMAN)
  Core: VPLDCVLYR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRQXPLXCXLYXYGS

SEQ ID NO: 330662 - protein, 25 aa, Artificial Sequence
  Description of Artificial Sequence: Synthetic peptide
  Seed: LDGTATLRLVKRQVPLDCVLYRYGS (PMEL_HUMAN)
  Core: LDCVLYRYG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLVKRQVPXDCXLXRYXS

SEQ ID NO: 330663 - protein, 13 aa, Artificial Sequence
  Description of Artificial Sequence: Synthetic peptide
  Seed: LDIVQGIESAEIL (PMEL_HUMAN)
  Core: VQGIESAEI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDIXQGXEXAEXL

SEQ ID NO: 330664 - protein, 14 aa, Artificial Sequence
  Description of Artificial Sequence: Synthetic peptide
  Seed: LDIVQGIESAEILQ (PMEL_HUMAN)
  Core: VQGIESAEI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDIXQGXEXAEXLQ

SEQ ID NO: 330665 - protein, 15 aa, Artificial Sequence
  Description of Artificial Sequence: Synthetic peptide
  Seed: LDIVQGIESAEILQA (PMEL_HUMAN)
  Core: VQGIESAEI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDIXQGXEXAEXLQA

SEQ ID NO: 330666 - protein, 15 aa, Artificial Sequence
  Description of Artificial Sequence: Synthetic peptide
  Seed: LDIVQGIESAEILQA (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQX

SEQ ID NO: 330667 - protein, 16 aa, Artificial Sequence
  Description of Artificial Sequence: Synthetic peptide
  Seed: LDIVQGIESAEILQAV (PMEL_HUMAN)
  Core: VQGIESAEI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDIXQGXEXAEXLQAV

SEQ ID NO: 330668 - protein, 16 aa, Artificial Sequence
  Description of Artificial Sequence: Synthetic peptide
  Seed: LDIVQGIESAEILQAV (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXV

SEQ ID NO: 330669 - protein, 17 aa, Artificial Sequence
  Description of Artificial Sequence: Synthetic peptide
  Seed: LDIVQGIESAEILQAVP (PMEL_HUMAN)
  Core: VQGIESAEI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDIXQGXEXAEXLQAVP

SEQ ID NO: 330670 - protein, 17 aa, Artificial Sequence
  Description of Artificial Sequence: Synthetic peptide
  Seed: LDIVQGIESAEILQAVP (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVP

SEQ ID NO: 330671 - protein, 18 aa, Artificial Sequence
  Description of Artificial Sequence: Synthetic peptide
  Seed: LDIVQGIESAEILQAVPS (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPS

SEQ ID NO: 330672 - protein, 19 aa, Artificial Sequence
  Description of Artificial Sequence: Synthetic peptide
  Seed: LDIVQGIESAEILQAVPSG (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSG

SEQ ID NO: 330673 - protein, 20 aa, Artificial Sequence
  Description of Artificial Sequence: Synthetic peptide
  Seed: LDIVQGIESAEILQAVPSGE (PMEL_HUMAN)
  Core: VQGIESAEI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDIXQGXEXAEXLQAVPSGE

SEQ ID NO: 330674 - protein, 20 aa, Artificial Sequence
  Description of Artificial Sequence: Synthetic peptide
  Seed: LDIVQGIESAEILQAVPSGE (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSGE

SEQ ID NO: 330675 - protein, 20 aa, Artificial Sequence
  Description of Artificial Sequence: Synthetic peptide
  Seed: LDIVQGIESAEILQAVPSGE (PMEL_HUMAN)
  Core: ESAEILQAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIXSAXIXQAXPSGE

SEQ ID NO: 330676 - protein, 20 aa, Artificial Sequence
  Description of Artificial Sequence: Synthetic peptide
  Seed: LDIVQGIESAEILQAVPSGE (PMEL_HUMAN)
  Core: AEILQAVPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESXEIXQXVPXGE

SEQ ID NO: 330677 - protein, 21 aa, Artificial Sequence
  Description of Artificial Sequence: Synthetic peptide
  Seed: LDIVQGIESAEILQAVPSGEG (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSGEG

SEQ ID NO: 330678 - protein, 21 aa, Artificial Sequence
  Description of Artificial Sequence: Synthetic peptide
  Seed: LDIVQGIESAEILQAVPSGEG (PMEL_HUMAN)
  Core: ESAEILQAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIXSAXIXQAXPSGEG

SEQ ID NO: 330679 - protein, 21 aa, Artificial Sequence
  Description of Artificial Sequence: Synthetic peptide
  Seed: LDIVQGIESAEILQAVPSGEG (PMEL_HUMAN)
  Core: AEILQAVPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESXEIXQXVPXGEG

SEQ ID NO: 330680 - protein, 22 aa, Artificial Sequence
  Description of Artificial Sequence: Synthetic peptide
  Seed: LDIVQGIESAEILQAVPSGEGD (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSGEGD

SEQ ID NO: 330681 - protein, 22 aa, Artificial Sequence
  Description of Artificial Sequence: Synthetic peptide
  Seed: LDIVQGIESAEILQAVPSGEGD (PMEL_HUMAN)
  Core: ESAEILQAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIXSAXIXQAXPSGEGD

SEQ ID NO: 330682 - protein, 22 aa, Artificial Sequence
  Description of Artificial Sequence: Synthetic peptide
  Seed: LDIVQGIESAEILQAVPSGEGD (PMEL_HUMAN)
  Core: AEILQAVPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESXEIXQXVPXGEGD

SEQ ID NO: 330683 - protein, 23 aa, Artificial Sequence
  Description of Artificial Sequence: Synthetic peptide
  Seed: LDIVQGIESAEILQAVPSGEGDA (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSGEGDA

SEQ ID NO: 330684 - protein, 23 aa, Artificial Sequence
  Description of Artificial Sequence: Synthetic peptide
  Seed: LDIVQGIESAEILQAVPSGEGDA (PMEL_HUMAN)
  Core: ESAEILQAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIXSAXIXQAXPSGEGDA

SEQ ID NO: 330685 - protein, 23 aa, Artificial Sequence
  Description of Artificial Sequence: Synthetic peptide
  Seed: LDIVQGIESAEILQAVPSGEGDA (PMEL_HUMAN)
  Core: AEILQAVPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESXEIXQXVPXGEGDA

SEQ ID NO: 330686 - protein, 23 aa, Artificial Sequence
  Description of Artificial Sequence: Synthetic peptide
  Seed: LDIVQGIESAEILQAVPSGEGDA (PMEL_HUMAN)
  Core: LQAVPSGEG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESAEIXQAXPXGEXDA

SEQ ID NO: 330687 - protein, 24 aa, Artificial Sequence
  Description of Artificial Sequence: Synthetic peptide
  Seed: LDIVQGIESAEILQAVPSGEGDAF (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSGEGDAF

SEQ ID NO: 330688 - protein, 24 aa, Artificial Sequence
  Description of Artificial Sequence: Synthetic peptide
  Seed: LDIVQGIESAEILQAVPSGEGDAF (PMEL_HUMAN)
  Core: ESAEILQAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIXSAXIXQAXPSGEGDAF

SEQ ID NO: 330689 - protein, 24 aa, Artificial Sequence
  Description of Artificial Sequence: Synthetic peptide
  Seed: LDIVQGIESAEILQAVPSGEGDAF (PMEL_HUMAN)
  Core: AEILQAVPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESXEIXQXVPXGEGDAF

SEQ ID NO: 330690 - protein, 24 aa, Artificial Sequence
  Description of Artificial Sequence: Synthetic peptide
  Seed: LDIVQGIESAEILQAVPSGEGDAF (PMEL_HUMAN)
  Core: LQAVPSGEG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESAEIXQAXPXGEXDAF

SEQ ID NO: 330691 - protein, 25 aa, Artificial Sequence
  Description of Artificial Sequence: Synthetic peptide
  Seed: LDIVQGIESAEILQAVPSGEGDAFE (PMEL_HUMAN)
  Core: IESAEILQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGXESXEXLQXVPSGEGDAFE

SEQ ID NO: 330692 - protein, 25 aa, Artificial Sequence
  Description of Artificial Sequence: Synthetic peptide
  Seed: LDIVQGIESAEILQAVPSGEGDAFE (PMEL_HUMAN)
  Core: ESAEILQAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIXSAXIXQAXPSGEGDAFE

SEQ ID NO: 330693 - protein, 25 aa, Artificial Sequence
  Description of Artificial Sequence: Synthetic peptide
  Seed: LDIVQGIESAEILQAVPSGEGDAFE (PMEL_HUMAN)
  Core: AEILQAVPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESXEIXQXVPXGEGDAFE

SEQ ID NO: 330694 - protein, 25 aa, Artificial Sequence
  Description of Artificial Sequence: Synthetic peptide
  Seed: LDIVQGIESAEILQAVPSGEGDAFE (PMEL_HUMAN)
  Core: LQAVPSGEG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDIVQGIESAEIXQAXPXGEXDAFE

SEQ ID NO: 330695 - protein, 13 aa, Artificial Sequence
  Description of Artificial Sequence: Synthetic peptide
  Seed: LEPGPVTAQVVLQ (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLX

SEQ ID NO: 330696 - protein, 14 aa, Artificial Sequence
  Description of Artificial Sequence: Synthetic peptide
  Seed: LEPGPVTAQVVLQA (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXA

SEQ ID NO: 330697 - protein, 15 aa, Artificial Sequence
  Description of Artificial Sequence: Synthetic peptide
  Seed: LEPGPVTAQVVLQAA (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAA

SEQ ID NO: 330698 - protein, 15 aa, Artificial Sequence
  Description of Artificial Sequence: Synthetic peptide
  Seed: LEPGPVTAQVVLQAA (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXA

SEQ ID NO: 330699 - protein, 16 aa, Artificial Sequence
  Description of Artificial Sequence: Synthetic peptide
  Seed: LEPGPVTAQVVLQAAI (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAI

SEQ ID NO: 330700 - protein, 16 aa, Artificial Sequence
  Description of Artificial Sequence: Synthetic peptide
  Seed: LEPGPVTAQVVLQAAI (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAI

SEQ ID NO: 330701 - protein, 16 aa, Artificial Sequence
  Description of Artificial Sequence: Synthetic peptide
  Seed: LEPGPVTAQVVLQAAI (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXI

SEQ ID NO: 330702 - protein, 17 aa, Artificial Sequence
  Description of Artificial Sequence: Synthetic peptide
  Seed: LEPGPVTAQVVLQAAIP (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIP

SEQ ID NO: 330703 - protein, 17 aa, Artificial Sequence
  Description of Artificial Sequence: Synthetic peptide
  Seed: LEPGPVTAQVVLQAAIP (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIP

SEQ ID NO: 330704 - protein, 17 aa, Artificial Sequence
  Description of Artificial Sequence: Synthetic peptide
  Seed: LEPGPVTAQVVLQAAIP (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIP

SEQ ID NO: 330705 - protein, 18 aa, Artificial Sequence
  Description of Artificial Sequence: Synthetic peptide
  Seed: LEPGPVTAQVVLQAAIPL (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPL

SEQ ID NO: 330706 - protein, 18 aa, Artificial Sequence
  Description of Artificial Sequence: Synthetic peptide
  Seed: LEPGPVTAQVVLQAAIPL (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPL

SEQ ID NO: 330707 - protein, 18 aa, Artificial Sequence
  Description of Artificial Sequence: Synthetic peptide
  Seed: LEPGPVTAQVVLQAAIPL (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPL

SEQ ID NO: 330708 - protein, 19 aa, Artificial Sequence
  Description of Artificial Sequence: Synthetic peptide
  Seed: LEPGPVTAQVVLQAAIPLT (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLT

SEQ ID NO: 330709 - protein, 19 aa, Artificial Sequence
  Description of Artificial Sequence: Synthetic peptide
  Seed: LEPGPVTAQVVLQAAIPLT (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLT

SEQ ID NO: 330710 - protein, 19 aa, Artificial Sequence
  Description of Artificial Sequence: Synthetic peptide
  Seed: LEPGPVTAQVVLQAAIPLT (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLT

SEQ ID NO: 330711 - protein, 19 aa, Artificial Sequence
  Description of Artificial Sequence: Synthetic peptide
  Seed: LEPGPVTAQVVLQAAIPLT (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXT

SEQ ID NO: 330712 - protein, 20 aa, Artificial Sequence
  Description of Artificial Sequence: Synthetic peptide
  Seed: LEPGPVTAQVVLQAAIPLTS (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLTS

SEQ ID NO: 330713 - protein, 20 aa, Artificial Sequence
  Description of Artificial Sequence: Synthetic peptide
  Seed: LEPGPVTAQVVLQAAIPLTS (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLTS

SEQ ID NO: 330714 - protein, 20 aa, Artificial Sequence
  Description of Artificial Sequence: Synthetic peptide
  Seed: LEPGPVTAQVVLQAAIPLTS (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLTS

SEQ ID NO: 330715 - protein, 20 aa, Artificial Sequence
  Description of Artificial Sequence: Synthetic peptide
  Seed: LEPGPVTAQVVLQAAIPLTS (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXTS

SEQ ID NO: 330716 - protein, 20 aa, Artificial Sequence
  Description of Artificial Sequence: Synthetic peptide
  Seed: LEPGPVTAQVVLQAAIPLTS (PMEL_HUMAN)
  Core: LQAAIPLTS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQVVXQAXIXLTX

SEQ ID NO: 330717 - protein, 21 aa, Artificial Sequence
  Description of Artificial Sequence: Synthetic peptide
  Seed: LEPGPVTAQVVLQAAIPLTSC (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLTSC

SEQ ID NO: 330718 - protein, 21 aa, Artificial Sequence
  Description of Artificial Sequence: Synthetic peptide
  Seed: LEPGPVTAQVVLQAAIPLTSC (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLTSC

SEQ ID NO: 330719 - protein, 21 aa, Artificial Sequence
  Description of Artificial Sequence: Synthetic peptide
  Seed: LEPGPVTAQVVLQAAIPLTSC (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLTSC

SEQ ID NO: 330720 - protein, 21 aa, Artificial Sequence
  Description of Artificial Sequence: Synthetic peptide
  Seed: LEPGPVTAQVVLQAAIPLTSC (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXTSC

SEQ ID NO: 330721 - protein, 21 aa, Artificial Sequence
  Description of Artificial Sequence: Synthetic peptide
  Seed: LEPGPVTAQVVLQAAIPLTSC (PMEL_HUMAN)
  Core: LQAAIPLTS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQVVXQAXIXLTXC

SEQ ID NO: 330722 - protein, 22 aa, Artificial Sequence
  Description of Artificial Sequence: Synthetic peptide
  Seed: LEPGPVTAQVVLQAAIPLTSCG (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLTSCG

SEQ ID NO: 330723 - protein, 22 aa, Artificial Sequence
  Description of Artificial Sequence: Synthetic peptide
  Seed: LEPGPVTAQVVLQAAIPLTSCG (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLTSCG

SEQ ID NO: 330724 - protein, 22 aa, Artificial Sequence
  Description of Artificial Sequence: Synthetic peptide
  Seed: LEPGPVTAQVVLQAAIPLTSCG (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLTSCG

SEQ ID NO: 330725 - protein, 22 aa, Artificial Sequence
  Description of Artificial Sequence: Synthetic peptide
  Seed: LEPGPVTAQVVLQAAIPLTSCG (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXTSCG

SEQ ID NO: 330726 - protein, 22 aa, Artificial Sequence
  Description of Artificial Sequence: Synthetic peptide
  Seed: LEPGPVTAQVVLQAAIPLTSCG (PMEL_HUMAN)
  Core: LQAAIPLTS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQVVXQAXIXLTXCG

SEQ ID NO: 330727 - protein, 23 aa, Artificial Sequence
  Description of Artificial Sequence: Synthetic peptide
  Seed: LEPGPVTAQVVLQAAIPLTSCGS (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLTSCGS

SEQ ID NO: 330728 - protein, 23 aa, Artificial Sequence
  Description of Artificial Sequence: Synthetic peptide
  Seed: LEPGPVTAQVVLQAAIPLTSCGS (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLTSCGS

SEQ ID NO: 330729 - protein, 23 aa, Artificial Sequence
  Description of Artificial Sequence: Synthetic peptide
  Seed: LEPGPVTAQVVLQAAIPLTSCGS (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLTSCGS

SEQ ID NO: 330730 - protein, 23 aa, Artificial Sequence
  Description of Artificial Sequence: Synthetic peptide
  Seed: LEPGPVTAQVVLQAAIPLTSCGS (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXTSCGS

SEQ ID NO: 330731 - protein, 23 aa, Artificial Sequence
  Description of Artificial Sequence: Synthetic peptide
  Seed: LEPGPVTAQVVLQAAIPLTSCGS (PMEL_HUMAN)
  Core: LQAAIPLTS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQVVXQAXIXLTXCGS

SEQ ID NO: 330732 - protein, 24 aa, Artificial Sequence
  Description of Artificial Sequence: Synthetic peptide
  Seed: LEPGPVTAQVVLQAAIPLTSCGSS (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLTSCGSS

SEQ ID NO: 330733 - protein, 24 aa, Artificial Sequence
  Description of Artificial Sequence: Synthetic peptide
  Seed: LEPGPVTAQVVLQAAIPLTSCGSS (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLTSCGSS

SEQ ID NO: 330734 - protein, 24 aa, Artificial Sequence
  Description of Artificial Sequence: Synthetic peptide
  Seed: LEPGPVTAQVVLQAAIPLTSCGSS (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLTSCGSS

SEQ ID NO: 330735 - protein, 24 aa, Artificial Sequence
  Description of Artificial Sequence: Synthetic peptide
  Seed: LEPGPVTAQVVLQAAIPLTSCGSS (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXTSCGSS

SEQ ID NO: 330736 - protein, 24 aa, Artificial Sequence
  Description of Artificial Sequence: Synthetic peptide
  Seed: LEPGPVTAQVVLQAAIPLTSCGSS (PMEL_HUMAN)
  Core: LQAAIPLTS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQVVXQAXIXLTXCGSS

SEQ ID NO: 330737 - protein, 25 aa, Artificial Sequence
  Description of Artificial Sequence: Synthetic peptide
  Seed: LEPGPVTAQVVLQAAIPLTSCGSSP (PMEL_HUMAN)
  Core: PVTAQVVLQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEPGXVTXQXVLXAAIPLTSCGSSP

SEQ ID NO: 330738 - protein, 25 aa, Artificial Sequence
  Description of Artificial Sequence: Synthetic peptide
  Seed: LEPGPVTAQVVLQAAIPLTSCGSSP (PMEL_HUMAN)
  Core: VTAQVVLQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPXTAXVXLQXAIPLTSCGSSP

SEQ ID NO: 330739 - protein, 25 aa, Artificial Sequence
  Description of Artificial Sequence: Synthetic peptide
  Seed: LEPGPVTAQVVLQAAIPLTSCGSSP (PMEL_HUMAN)
  Core: TAQVVLQAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVXAQXVXQAXIPLTSCGSSP

SEQ ID NO: 330740 - protein, 25 aa, Artificial Sequence
  Description of Artificial Sequence: Synthetic peptide
  Seed: LEPGPVTAQVVLQAAIPLTSCGSSP (PMEL_HUMAN)
  Core: VVLQAAIPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQXVLXAXIPXTSCGSSP

SEQ ID NO: 330741 - protein, 25 aa, Artificial Sequence
  Description of Artificial Sequence: Synthetic peptide
  Seed: LEPGPVTAQVVLQAAIPLTSCGSSP (PMEL_HUMAN)
  Core: LQAAIPLTS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LEPGPVTAQVVXQAXIXLTXCGSSP

SEQ ID NO: 330742 - protein, 13 aa, Artificial Sequence
  Description of Artificial Sequence: Synthetic peptide
  Seed: LGGPVSGLSIGTG (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXG

SEQ ID NO: 330743 - protein, 14 aa, Artificial Sequence
  Description of Artificial Sequence: Synthetic peptide
  Seed: LGGPVSGLSIGTGR (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXGR

SEQ ID NO: 330744 - protein, 15 aa, Artificial Sequence
  Description of Artificial Sequence: Synthetic peptide
  Seed: LGGPVSGLSIGTGRA (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXGRA

SEQ ID NO: 330745 - protein, 15 aa, Artificial Sequence
  Description of Artificial Sequence: Synthetic peptide
  Seed: LGGPVSGLSIGTGRA (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRA

SEQ ID NO: 330746 - protein, 16 aa, Artificial Sequence
  Description of Artificial Sequence: Synthetic peptide
  Seed: LGGPVSGLSIGTGRAM (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXGRAM

SEQ ID NO: 330747 - protein, 16 aa, Artificial Sequence
  Description of Artificial Sequence: Synthetic peptide
  Seed: LGGPVSGLSIGTGRAM (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAM

SEQ ID NO: 330748 - protein, 16 aa, Artificial Sequence
  Description of Artificial Sequence: Synthetic peptide
  Seed: LGGPVSGLSIGTGRAM (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAX

SEQ ID NO: 330749 - protein, 17 aa, Artificial Sequence
  Description of Artificial Sequence: Synthetic peptide
  Seed: LGGPVSGLSIGTGRAML (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXGRAML

SEQ ID NO: 330750 - protein, 17 aa, Artificial Sequence
  Description of Artificial Sequence: Synthetic peptide
  Seed: LGGPVSGLSIGTGRAML (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAML

SEQ ID NO: 330751 - protein, 17 aa, Artificial Sequence
  Description of Artificial Sequence: Synthetic peptide
  Seed: LGGPVSGLSIGTGRAML (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXL

SEQ ID NO: 330752 - protein, 18 aa, Artificial Sequence
  Description of Artificial Sequence: Synthetic peptide
  Seed: LGGPVSGLSIGTGRAMLG (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXGRAMLG

SEQ ID NO: 330753 - protein, 18 aa, Artificial Sequence
  Description of Artificial Sequence: Synthetic peptide
  Seed: LGGPVSGLSIGTGRAMLG (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLG

SEQ ID NO: 330754 - protein, 19 aa, Artificial Sequence
  Description of Artificial Sequence: Synthetic peptide
  Seed: LGGPVSGLSIGTGRAMLGT (PMEL_HUMAN)
  Core: PVSGLSIGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGGXVSXLXIGXGRAMLGT

SEQ ID NO: 330755 - protein, 19 aa, Artificial Sequence
  Description of Artificial Sequence: Synthetic peptide
  Seed: LGGPVSGLSIGTGRAMLGT (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLGT

SEQ ID NO: 330756 - protein, 19 aa, Artificial Sequence
  Description of Artificial Sequence: Synthetic peptide
  Seed: LGGPVSGLSIGTGRAMLGT (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGT

SEQ ID NO: 330757 - protein, 19 aa, Artificial Sequence
  Description of Artificial Sequence: Synthetic peptide
  Seed: LGGPVSGLSIGTGRAMLGT (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXT

SEQ ID NO: 330758 - protein, 20 aa, Artificial Sequence
  Description of Artificial Sequence: Synthetic peptide
  Seed: LGGPVSGLSIGTGRAMLGTH (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLGTH

SEQ ID NO: 330759 - protein, 20 aa, Artificial Sequence
  Description of Artificial Sequence: Synthetic peptide
  Seed: LGGPVSGLSIGTGRAMLGTH (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGTH

SEQ ID NO: 330760 - protein, 20 aa, Artificial Sequence
  Description of Artificial Sequence: Synthetic peptide
  Seed: LGGPVSGLSIGTGRAMLGTH (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXTH

SEQ ID NO: 330761 - protein, 21 aa, Artificial Sequence
  Description of Artificial Sequence: Synthetic peptide
  Seed: LGGPVSGLSIGTGRAMLGTHT (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGTHT

SEQ ID NO: 330762 - protein, 21 aa, Artificial Sequence
  Description of Artificial Sequence: Synthetic peptide
  Seed: LGGPVSGLSIGTGRAMLGTHT (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXTHT

SEQ ID NO: 330763 - protein, 22 aa, Artificial Sequence
  Description of Artificial Sequence: Synthetic peptide
  Seed: LGGPVSGLSIGTGRAMLGTHTM (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLGTHTM

SEQ ID NO: 330764 - protein, 22 aa, Artificial Sequence
  Description of Artificial Sequence: Synthetic peptide
  Seed: LGGPVSGLSIGTGRAMLGTHTM (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGTHTM

SEQ ID NO: 330765 - protein, 22 aa, Artificial Sequence
  Description of Artificial Sequence: Synthetic peptide
  Seed: LGGPVSGLSIGTGRAMLGTHTM (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXTHTM

SEQ ID NO: 330766 - protein, 23 aa, Artificial Sequence
  Description of Artificial Sequence: Synthetic peptide
  Seed: LGGPVSGLSIGTGRAMLGTHTME (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLGTHTME

SEQ ID NO: 330767 - protein, 23 aa, Artificial Sequence
  Description of Artificial Sequence: Synthetic peptide
  Seed: LGGPVSGLSIGTGRAMLGTHTME (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGTHTME

SEQ ID NO: 330768 - protein, 23 aa, Artificial Sequence
  Description of Artificial Sequence: Synthetic peptide
  Seed: LGGPVSGLSIGTGRAMLGTHTME (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXTHTME

SEQ ID NO: 330769 - protein, 24 aa, Artificial Sequence
  Description of Artificial Sequence: Synthetic peptide
  Seed: LGGPVSGLSIGTGRAMLGTHTMEV (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLGTHTMEV

SEQ ID NO: 330770 - protein, 24 aa, Artificial Sequence
  Description of Artificial Sequence: Synthetic peptide
  Seed: LGGPVSGLSIGTGRAMLGTHTMEV (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGTHTMEV

SEQ ID NO: 330771 - protein, 24 aa, Artificial Sequence
  Description of Artificial Sequence: Synthetic peptide
  Seed: LGGPVSGLSIGTGRAMLGTHTMEV (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXTHTMEV

SEQ ID NO: 330772 - protein, 24 aa, Artificial Sequence
  Description of Artificial Sequence: Synthetic peptide
  Seed: LGGPVSGLSIGTGRAMLGTHTMEV (PMEL_HUMAN)
  Core: MLGTHTMEV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSIGTGRAXLGXHXMEX

SEQ ID NO: 330773 - protein, 25 aa, Artificial Sequence
  Description of Artificial Sequence: Synthetic peptide
  Seed: LGGPVSGLSIGTGRAMLGTHTMEVT (PMEL_HUMAN)
  Core: VSGLSIGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGGPXSGXSXGTXRAMLGTHTMEVT

SEQ ID NO: 330774 - protein, 25 aa, Artificial Sequence
  Description of Artificial Sequence: Synthetic peptide
  Seed: LGGPVSGLSIGTGRAMLGTHTMEVT (PMEL_HUMAN)
  Core: LSIGTGRAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGXSIXTXRAXLGTHTMEVT

SEQ ID NO: 330775 - protein, 25 aa, Artificial Sequence
  Description of Artificial Sequence: Synthetic peptide
  Seed: LGGPVSGLSIGTGRAMLGTHTMEVT (PMEL_HUMAN)
  Core: IGTGRAMLG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSXGTXRXMLXTHTMEVT

SEQ ID NO: 330776 - protein, 25 aa, Artificial Sequence
  Description of Artificial Sequence: Synthetic peptide
  Seed: LGGPVSGLSIGTGRAMLGTHTMEVT (PMEL_HUMAN)
  Core: MLGTHTMEV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LGGPVSGLSIGTGRAXLGXHXMEXT

SEQ ID NO: 330777 - protein, 14 aa, Artificial Sequence
  Description of Artificial Sequence: Synthetic peptide
  Seed: LGPLLDGTATLRLV (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXV

SEQ ID NO: 330778 - protein, 15 aa, Artificial Sequence
  Description of Artificial Sequence: Synthetic peptide
  Seed: LGPLLDGTATLRLVK (PMEL_HUMAN)
  Core: LLDGTATLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGPXLDXTXTLXLVK

SEQ ID NO: 330779 - protein, 15 aa, Artificial Sequence
  Description of Artificial Sequence: Synthetic peptide
  Seed: LGPLLDGTATLRLVK (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVK

SEQ ID NO: 330780 - protein, 16 aa, Artificial Sequence
  Description of Artificial Sequence: Synthetic peptide
  Seed: LGPLLDGTATLRLVKR (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKR

SEQ ID NO: 330781 - protein, 17 aa, Artificial Sequence
  Description of Artificial Sequence: Synthetic peptide
  Seed: LGPLLDGTATLRLVKRQ (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQ

SEQ ID NO: 330782 - protein, 17 aa, Artificial Sequence
  Description of Artificial Sequence: Synthetic peptide
  Seed: LGPLLDGTATLRLVKRQ (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQ

SEQ ID NO: 330783 - protein, 18 aa, Artificial Sequence
  Description of Artificial Sequence: Synthetic peptide
  Seed: LGPLLDGTATLRLVKRQV (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQV

SEQ ID NO: 330784 - protein, 18 aa, Artificial Sequence
  Description of Artificial Sequence: Synthetic peptide
  Seed: LGPLLDGTATLRLVKRQV (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQV

SEQ ID NO: 330785 - protein, 19 aa, Artificial Sequence
  Description of Artificial Sequence: Synthetic peptide
  Seed: LGPLLDGTATLRLVKRQVP (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVP

SEQ ID NO: 330786 - protein, 19 aa, Artificial Sequence
  Description of Artificial Sequence: Synthetic peptide
  Seed: LGPLLDGTATLRLVKRQVP (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVP

SEQ ID NO: 330787 - protein, 19 aa, Artificial Sequence
  Description of Artificial Sequence: Synthetic peptide
  Seed: LGPLLDGTATLRLVKRQVP (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVX

SEQ ID NO: 330788 - protein, 20 aa, Artificial Sequence
  Description of Artificial Sequence: Synthetic peptide
  Seed: LGPLLDGTATLRLVKRQVPL (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVPL

SEQ ID NO: 330789 - protein, 20 aa, Artificial Sequence
  Description of Artificial Sequence: Synthetic peptide
  Seed: LGPLLDGTATLRLVKRQVPL (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVPL

SEQ ID NO: 330790 - protein, 20 aa, Artificial Sequence
  Description of Artificial Sequence: Synthetic peptide
  Seed: LGPLLDGTATLRLVKRQVPL (PMEL_HUMAN)
  Core: TATLRLVKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGXATXRXVKXQVPL

SEQ ID NO: 330791 - protein, 20 aa, Artificial Sequence
  Description of Artificial Sequence: Synthetic peptide
  Seed: LGPLLDGTATLRLVKRQVPL (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVXL

SEQ ID NO: 330792 - protein, 21 aa, Artificial Sequence
  Description of Artificial Sequence: Synthetic peptide
  Seed: LGPLLDGTATLRLVKRQVPLD (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVPLD

SEQ ID NO: 330793 - protein, 21 aa, Artificial Sequence
  Description of Artificial Sequence: Synthetic peptide
  Seed: LGPLLDGTATLRLVKRQVPLD (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVPLD

SEQ ID NO: 330794 - protein, 21 aa, Artificial Sequence
  Description of Artificial Sequence: Synthetic peptide
  Seed: LGPLLDGTATLRLVKRQVPLD (PMEL_HUMAN)
  Core: TATLRLVKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGXATXRXVKXQVPLD

SEQ ID NO: 330795 - protein, 21 aa, Artificial Sequence
  Description of Artificial Sequence: Synthetic peptide
  Seed: LGPLLDGTATLRLVKRQVPLD (PMEL_HUMAN)
  Core: TLRLVKRQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTAXLRXVXRQXPLD

SEQ ID NO: 330796 - protein, 21 aa, Artificial Sequence
  Description of Artificial Sequence: Synthetic peptide
  Seed: LGPLLDGTATLRLVKRQVPLD (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVXLD

SEQ ID NO: 330797 - protein, 22 aa, Artificial Sequence
  Description of Artificial Sequence: Synthetic peptide
  Seed: LGPLLDGTATLRLVKRQVPLDC (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVPLDC

SEQ ID NO: 330798 - protein, 22 aa, Artificial Sequence
  Description of Artificial Sequence: Synthetic peptide
  Seed: LGPLLDGTATLRLVKRQVPLDC (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVPLDC

SEQ ID NO: 330799 - protein, 22 aa, Artificial Sequence
  Description of Artificial Sequence: Synthetic peptide
  Seed: LGPLLDGTATLRLVKRQVPLDC (PMEL_HUMAN)
  Core: TATLRLVKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGXATXRXVKXQVPLDC

SEQ ID NO: 330800 - protein, 22 aa, Artificial Sequence
  Description of Artificial Sequence: Synthetic peptide
  Seed: LGPLLDGTATLRLVKRQVPLDC (PMEL_HUMAN)
  Core: TLRLVKRQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTAXLRXVXRQXPLDC

SEQ ID NO: 330801 - protein, 22 aa, Artificial Sequence
  Description of Artificial Sequence: Synthetic peptide
  Seed: LGPLLDGTATLRLVKRQVPLDC (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVXLDC

SEQ ID NO: 330802 - protein, 23 aa, Artificial Sequence
  Description of Artificial Sequence: Synthetic peptide
  Seed: LGPLLDGTATLRLVKRQVPLDCV (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVPLDCV

SEQ ID NO: 330803 - protein, 23 aa, Artificial Sequence
  Description of Artificial Sequence: Synthetic peptide
  Seed: LGPLLDGTATLRLVKRQVPLDCV (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVPLDCV

SEQ ID NO: 330804 - protein, 23 aa, Artificial Sequence
  Description of Artificial Sequence: Synthetic peptide
  Seed: LGPLLDGTATLRLVKRQVPLDCV (PMEL_HUMAN)
  Core: TATLRLVKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGXATXRXVKXQVPLDCV

SEQ ID NO: 330805 - protein, 23 aa, Artificial Sequence
  Description of Artificial Sequence: Synthetic peptide
  Seed: LGPLLDGTATLRLVKRQVPLDCV (PMEL_HUMAN)
  Core: TLRLVKRQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTAXLRXVXRQXPLDCV

SEQ ID NO: 330806 - protein, 23 aa, Artificial Sequence
  Description of Artificial Sequence: Synthetic peptide
  Seed: LGPLLDGTATLRLVKRQVPLDCV (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVXLDCV

SEQ ID NO: 330807 - protein, 23 aa, Artificial Sequence
  Description of Artificial Sequence: Synthetic peptide
  Seed: LGPLLDGTATLRLVKRQVPLDCV (PMEL_HUMAN)
  Core: LVKRQVPLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATLRXVKXQXPLXCV

SEQ ID NO: 330808 - protein, 24 aa, Artificial Sequence
  Description of Artificial Sequence: Synthetic peptide
  Seed: LGPLLDGTATLRLVKRQVPLDCVL (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVPLDCVL

SEQ ID NO: 330809 - protein, 24 aa, Artificial Sequence
  Description of Artificial Sequence: Synthetic peptide
  Seed: LGPLLDGTATLRLVKRQVPLDCVL (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVPLDCVL

SEQ ID NO: 330810 - protein, 24 aa, Artificial Sequence
  Description of Artificial Sequence: Synthetic peptide
  Seed: LGPLLDGTATLRLVKRQVPLDCVL (PMEL_HUMAN)
  Core: TATLRLVKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGXATXRXVKXQVPLDCVL

SEQ ID NO: 330811 - protein, 24 aa, Artificial Sequence
  Description of Artificial Sequence: Synthetic peptide
  Seed: LGPLLDGTATLRLVKRQVPLDCVL (PMEL_HUMAN)
  Core: TLRLVKRQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTAXLRXVXRQXPLDCVL

SEQ ID NO: 330812 - protein, 24 aa, Artificial Sequence
  Description of Artificial Sequence: Synthetic peptide
  Seed: LGPLLDGTATLRLVKRQVPLDCVL (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVXLDCVL

SEQ ID NO: 330813 - protein, 24 aa, Artificial Sequence
  Description of Artificial Sequence: Synthetic peptide
  Seed: LGPLLDGTATLRLVKRQVPLDCVL (PMEL_HUMAN)
  Core: LVKRQVPLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATLRXVKXQXPLXCVL

SEQ ID NO: 330814 - protein, 25 aa, Artificial Sequence
  Description of Artificial Sequence: Synthetic peptide
  Seed: LGPLLDGTATLRLVKRQVPLDCVLY (PMEL_HUMAN)
  Core: LDGTATLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGPLXDGXAXLRXVKRQVPLDCVLY

SEQ ID NO: 330815 - protein, 25 aa, Artificial Sequence
  Description of Artificial Sequence: Synthetic peptide
  Seed: LGPLLDGTATLRLVKRQVPLDCVLY (PMEL_HUMAN)
  Core: DGTATLRLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLXGTXTXRLXKRQVPLDCVLY

SEQ ID NO: 330816 - protein, 25 aa, Artificial Sequence
  Description of Artificial Sequence: Synthetic peptide
  Seed: LGPLLDGTATLRLVKRQVPLDCVLY (PMEL_HUMAN)
  Core: TATLRLVKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGXATXRXVKXQVPLDCVLY

SEQ ID NO: 330817 - protein, 25 aa, Artificial Sequence
  Description of Artificial Sequence: Synthetic peptide
  Seed: LGPLLDGTATLRLVKRQVPLDCVLY (PMEL_HUMAN)
  Core: TLRLVKRQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTAXLRXVXRQXPLDCVLY

SEQ ID NO: 330818 - protein, 25 aa, Artificial Sequence
  Description of Artificial Sequence: Synthetic peptide
  Seed: LGPLLDGTATLRLVKRQVPLDCVLY (PMEL_HUMAN)
  Core: LRLVKRQVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATXRLXKXQVXLDCVLY

SEQ ID NO: 330819 - protein, 25 aa, Artificial Sequence
  Description of Artificial Sequence: Synthetic peptide
  Seed: LGPLLDGTATLRLVKRQVPLDCVLY (PMEL_HUMAN)
  Core: RLVKRQVPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATLXLVXRXVPXDCVLY

SEQ ID NO: 330820 - protein, 25 aa, Artificial Sequence
  Description of Artificial Sequence: Synthetic peptide
  Seed: LGPLLDGTATLRLVKRQVPLDCVLY (PMEL_HUMAN)
  Core: LVKRQVPLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGPLLDGTATLRXVKXQXPLXCVLY

SEQ ID NO: 330821 - protein, 14 aa, Artificial Sequence
  Description of Artificial Sequence: Synthetic peptide
  Seed: LGQVPLIVGILLVL (PMEL_HUMAN)
  Core: VPLIVGILL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGQXPLXVXILXVL

SEQ ID NO: 330822 - protein, 15 aa, Artificial Sequence
  Description of Artificial Sequence: Synthetic peptide
  Seed: LGQVPLIVGILLVLM (PMEL_HUMAN)
  Core: VPLIVGILL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LGQXPLXVXILXVLM

SEQ ID NO: 330823 - protein, 15 aa, Artificial Sequence
  Description of Artificial Sequence: Synthetic peptide
  Seed: LGQVPLIVGILLVLM (PMEL_HUMAN)
  Core: LIVGILLVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPXIVXIXLVXM

SEQ ID NO: 330824 - protein, 15 aa, Artificial Sequence
  Description of Artificial Sequence: Synthetic peptide
  Seed: LGQVPLIVGILLVLM (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLX

SEQ ID NO: 330825 - protein, 16 aa, Artificial Sequence
  Description of Artificial Sequence: Synthetic peptide
  Seed: LGQVPLIVGILLVLMA (PMEL_HUMAN)
  Core: LIVGILLVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPXIVXIXLVXMA

SEQ ID NO: 330826 - protein, 16 aa, Artificial Sequence
  Description of Artificial Sequence: Synthetic peptide
  Seed: LGQVPLIVGILLVLMA (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXA

SEQ ID NO: 330827 - protein, 17 aa, Artificial Sequence
  Description of Artificial Sequence: Synthetic peptide
  Seed: LGQVPLIVGILLVLMAV (PMEL_HUMAN)
  Core: LIVGILLVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPXIVXIXLVXMAV

SEQ ID NO: 330828 - protein, 17 aa, Artificial Sequence
  Description of Artificial Sequence: Synthetic peptide
  Seed: LGQVPLIVGILLVLMAV (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAV

SEQ ID NO: 330829 - protein, 18 aa, Artificial Sequence
  Description of Artificial Sequence: Synthetic peptide
  Seed: LGQVPLIVGILLVLMAVV (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVV

SEQ ID NO: 330830 - protein, 19 aa, Artificial Sequence
  Description of Artificial Sequence: Synthetic peptide
  Seed: LGQVPLIVGILLVLMAVVL (PMEL_HUMAN)
  Core: LIVGILLVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPXIVXIXLVXMAVVL

SEQ ID NO: 330831 - protein, 19 aa, Artificial Sequence
  Description of Artificial Sequence: Synthetic peptide
  Seed: LGQVPLIVGILLVLMAVVL (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVL

SEQ ID NO: 330832 - protein, 20 aa, Artificial Sequence
  Description of Artificial Sequence: Synthetic peptide
  Seed: LGQVPLIVGILLVLMAVVLA (PMEL_HUMAN)
  Core: LIVGILLVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPXIVXIXLVXMAVVLA

SEQ ID NO: 330833 - protein, 20 aa, Artificial Sequence
  Description of Artificial Sequence: Synthetic peptide
  Seed: LGQVPLIVGILLVLMAVVLA (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVLA

SEQ ID NO: 330834 - protein, 20 aa, Artificial Sequence
  Description of Artificial Sequence: Synthetic peptide
  Seed: LGQVPLIVGILLVLMAVVLA (PMEL_HUMAN)
  Core: LLVLMAVVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGIXLVXMXVVXA

SEQ ID NO: 330835 - protein, 21 aa, Artificial Sequence
  Description of Artificial Sequence: Synthetic peptide
  Seed: LGQVPLIVGILLVLMAVVLAS (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVLAS

SEQ ID NO: 330836 - protein, 21 aa, Artificial Sequence
  Description of Artificial Sequence: Synthetic peptide
  Seed: LGQVPLIVGILLVLMAVVLAS (PMEL_HUMAN)
  Core: ILLVLMAVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGXLLXLXAVXLAS

SEQ ID NO: 330837 - protein, 21 aa, Artificial Sequence
  Description of Artificial Sequence: Synthetic peptide
  Seed: LGQVPLIVGILLVLMAVVLAS (PMEL_HUMAN)
  Core: LLVLMAVVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGIXLVXMXVVXAS

SEQ ID NO: 330838 - protein, 22 aa, Artificial Sequence
  Description of Artificial Sequence: Synthetic peptide
  Seed: LGQVPLIVGILLVLMAVVLASL (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVLASL

SEQ ID NO: 330839 - protein, 22 aa, Artificial Sequence
  Description of Artificial Sequence: Synthetic peptide
  Seed: LGQVPLIVGILLVLMAVVLASL (PMEL_HUMAN)
  Core: ILLVLMAVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGXLLXLXAVXLASL

SEQ ID NO: 330840 - protein, 22 aa, Artificial Sequence
  Description of Artificial Sequence: Synthetic peptide
  Seed: LGQVPLIVGILLVLMAVVLASL (PMEL_HUMAN)
  Core: LLVLMAVVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGIXLVXMXVVXASL

SEQ ID NO: 330841 - protein, 22 aa, Artificial Sequence
  Description of Artificial Sequence: Synthetic peptide
  Seed: LGQVPLIVGILLVLMAVVLASL (PMEL_HUMAN)
  Core: LVLMAVVLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGILXVLXAXVLXSL

SEQ ID NO: 330842 - protein, 23 aa, Artificial Sequence
  Description of Artificial Sequence: Synthetic peptide
  Seed: LGQVPLIVGILLVLMAVVLASLI (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVLASLI

SEQ ID NO: 330843 - protein, 23 aa, Artificial Sequence
  Description of Artificial Sequence: Synthetic peptide
  Seed: LGQVPLIVGILLVLMAVVLASLI (PMEL_HUMAN)
  Core: ILLVLMAVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGXLLXLXAVXLASLI

SEQ ID NO: 330844 - protein, 23 aa, Artificial Sequence
  Description of Artificial Sequence: Synthetic peptide
  Seed: LGQVPLIVGILLVLMAVVLASLI (PMEL_HUMAN)
  Core: LLVLMAVVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGIXLVXMXVVXASLI

SEQ ID NO: 330845 - protein, 23 aa, Artificial Sequence
  Description of Artificial Sequence: Synthetic peptide
  Seed: LGQVPLIVGILLVLMAVVLASLI (PMEL_HUMAN)
  Core: LVLMAVVLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGILXVLXAXVLXSLI

SEQ ID NO: 330846 - protein, 24 aa, Artificial Sequence
  Description of Artificial Sequence: Synthetic peptide
  Seed: LGQVPLIVGILLVLMAVVLASLIY (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVLASLIY

SEQ ID NO: 330847 - protein, 24 aa, Artificial Sequence
  Description of Artificial Sequence: Synthetic peptide
  Seed: LGQVPLIVGILLVLMAVVLASLIY (PMEL_HUMAN)
  Core: ILLVLMAVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGXLLXLXAVXLASLIY

SEQ ID NO: 330848 - protein, 24 aa, Artificial Sequence
  Description of Artificial Sequence: Synthetic peptide
  Seed: LGQVPLIVGILLVLMAVVLASLIY (PMEL_HUMAN)
  Core: LLVLMAVVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGIXLVXMXVVXASLIY

SEQ ID NO: 330849 - protein, 24 aa, Artificial Sequence
  Description of Artificial Sequence: Synthetic peptide
  Seed: LGQVPLIVGILLVLMAVVLASLIY (PMEL_HUMAN)
  Core: VLMAVVLAS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGILLXLMXVXLAXLIY

SEQ ID NO: 330850 - protein, 25 aa, Artificial Sequence
  Description of Artificial Sequence: Synthetic peptide
  Seed: LGQVPLIVGILLVLMAVVLASLIYR (PMEL_HUMAN)
  Core: LIVGILLVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPXIVXIXLVXMAVVLASLIYR

SEQ ID NO: 330851 - protein, 25 aa, Artificial Sequence
  Description of Artificial Sequence: Synthetic peptide
  Seed: LGQVPLIVGILLVLMAVVLASLIYR (PMEL_HUMAN)
  Core: IVGILLVLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLXVGXLXVLXAVVLASLIYR

SEQ ID NO: 330852 - protein, 25 aa, Artificial Sequence
  Description of Artificial Sequence: Synthetic peptide
  Seed: LGQVPLIVGILLVLMAVVLASLIYR (PMEL_HUMAN)
  Core: ILLVLMAVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGXLLXLXAVXLASLIYR

SEQ ID NO: 330853 - protein, 25 aa, Artificial Sequence
  Description of Artificial Sequence: Synthetic peptide
  Seed: LGQVPLIVGILLVLMAVVLASLIYR (PMEL_HUMAN)
  Core: LLVLMAVVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGIXLVXMXVVXASLIYR

SEQ ID NO: 330854 - protein, 25 aa, Artificial Sequence
  Description of Artificial Sequence: Synthetic peptide
  Seed: LGQVPLIVGILLVLMAVVLASLIYR (PMEL_HUMAN)
  Core: VLMAVVLAS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGILLXLMXVXLAXLIYR

SEQ ID NO: 330855 - protein, 25 aa, Artificial Sequence
  Description of Artificial Sequence: Synthetic peptide
  Seed: LGQVPLIVGILLVLMAVVLASLIYR (PMEL_HUMAN)
  Core: LMAVVLASL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGILLVXMAXVXASXIYR

SEQ ID NO: 330856 - protein, 25 aa, Artificial Sequence
  Description of Artificial Sequence: Synthetic peptide
  Seed: LGQVPLIVGILLVLMAVVLASLIYR (PMEL_HUMAN)
  Core: MAVVLASLI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LGQVPLIVGILLVLXAVXLXSLXYR

SEQ ID NO: 330857 - protein, 15 aa, Artificial Sequence
  Description of Artificial Sequence: Synthetic peptide
  Seed: LGTHTMEVTVYHRRG (PMEL_HUMAN)
  Core: MEVTVYHRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTXEVXVXHRXG

SEQ ID NO: 330858 - protein, 16 aa, Artificial Sequence
  Description of Artificial Sequence: Synthetic peptide
  Seed: LGTHTMEVTVYHRRGS (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGX

SEQ ID NO: 330859 - protein, 17 aa, Artificial Sequence
  Description of Artificial Sequence: Synthetic peptide
  Seed: LGTHTMEVTVYHRRGSR (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXR

SEQ ID NO: 330860 - protein, 18 aa, Artificial Sequence
  Description of Artificial Sequence: Synthetic peptide
  Seed: LGTHTMEVTVYHRRGSRS (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRS

SEQ ID NO: 330861 - protein, 19 aa, Artificial Sequence
  Description of Artificial Sequence: Synthetic peptide
  Seed: LGTHTMEVTVYHRRGSRSY (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSY

SEQ ID NO: 330862 - protein, 20 aa, Artificial Sequence
  Description of Artificial Sequence: Synthetic peptide
  Seed: LGTHTMEVTVYHRRGSRSYV (PMEL_HUMAN)
  Core: MEVTVYHRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTXEVXVXHRXGSRSYV

SEQ ID NO: 330863 - protein, 20 aa, Artificial Sequence
  Description of Artificial Sequence: Synthetic peptide
  Seed: LGTHTMEVTVYHRRGSRSYV (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSYV

SEQ ID NO: 330864 - protein, 21 aa, Artificial Sequence
  Description of Artificial Sequence: Synthetic peptide
  Seed: LGTHTMEVTVYHRRGSRSYVP (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSYVP

SEQ ID NO: 330865 - protein, 22 aa, Artificial Sequence
  Description of Artificial Sequence: Synthetic peptide
  Seed: LGTHTMEVTVYHRRGSRSYVPL (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSYVPL

SEQ ID NO: 330866 - protein, 23 aa, Artificial Sequence
  Description of Artificial Sequence: Synthetic peptide
  Seed: LGTHTMEVTVYHRRGSRSYVPLA (PMEL_HUMAN)
  Core: MEVTVYHRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTXEVXVXHRXGSRSYVPLA

SEQ ID NO: 330867 - protein, 23 aa, Artificial Sequence
  Description of Artificial Sequence: Synthetic peptide
  Seed: LGTHTMEVTVYHRRGSRSYVPLA (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSYVPLA

SEQ ID NO: 330868 - protein, 23 aa, Artificial Sequence
  Description of Artificial Sequence: Synthetic peptide
  Seed: LGTHTMEVTVYHRRGSRSYVPLA (PMEL_HUMAN)
  Core: YHRRGSRSY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVXHRXGXRSXVPLA

SEQ ID NO: 330869 - protein, 24 aa, Artificial Sequence
  Description of Artificial Sequence: Synthetic peptide
  Seed: LGTHTMEVTVYHRRGSRSYVPLAH (PMEL_HUMAN)
  Core: MEVTVYHRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTXEVXVXHRXGSRSYVPLAH

SEQ ID NO: 330870 - protein, 24 aa, Artificial Sequence
  Description of Artificial Sequence: Synthetic peptide
  Seed: LGTHTMEVTVYHRRGSRSYVPLAH (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSYVPLAH

SEQ ID NO: 330871 - protein, 24 aa, Artificial Sequence
  Description of Artificial Sequence: Synthetic peptide
  Seed: LGTHTMEVTVYHRRGSRSYVPLAH (PMEL_HUMAN)
  Core: YHRRGSRSY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVXHRXGXRSXVPLAH

SEQ ID NO: 330872 - protein, 24 aa, Artificial Sequence
  Description of Artificial Sequence: Synthetic peptide
  Seed: LGTHTMEVTVYHRRGSRSYVPLAH (PMEL_HUMAN)
  Core: RRGSRSYVP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVYHXRGXRXYVXLAH

SEQ ID NO: 330873 - protein, 24 aa, Artificial Sequence
  Description of Artificial Sequence: Synthetic peptide
  Seed: LGTHTMEVTVYHRRGSRSYVPLAH (PMEL_HUMAN)
  Core: GSRSYVPLA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVYHRRXSRXYXPLXH

SEQ ID NO: 330874 - protein, 25 aa, Artificial Sequence
  Description of Artificial Sequence: Synthetic peptide
  Seed: LGTHTMEVTVYHRRGSRSYVPLAHS (PMEL_HUMAN)
  Core: THTMEVTVY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXHTXEXTVXHRRGSRSYVPLAHS

SEQ ID NO: 330875 - protein, 25 aa, Artificial Sequence
  Description of Artificial Sequence: Synthetic peptide
  Seed: LGTHTMEVTVYHRRGSRSYVPLAHS (PMEL_HUMAN)
  Core: MEVTVYHRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTXEVXVXHRXGSRSYVPLAHS

SEQ ID NO: 330876 - protein, 25 aa, Artificial Sequence
  Description of Artificial Sequence: Synthetic peptide
  Seed: LGTHTMEVTVYHRRGSRSYVPLAHS (PMEL_HUMAN)
  Core: VTVYHRRGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEXTVXHXRGXRSYVPLAHS

SEQ ID NO: 330877 - protein, 25 aa, Artificial Sequence
  Description of Artificial Sequence: Synthetic peptide
  Seed: LGTHTMEVTVYHRRGSRSYVPLAHS (PMEL_HUMAN)
  Core: YHRRGSRSY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVXHRXGXRSXVPLAHS

SEQ ID NO: 330878 - protein, 25 aa, Artificial Sequence
  Description of Artificial Sequence: Synthetic peptide
  Seed: LGTHTMEVTVYHRRGSRSYVPLAHS (PMEL_HUMAN)
  Core: GSRSYVPLA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVYHRRXSRXYXPLXHS

SEQ ID NO: 330879 - protein, 25 aa, Artificial Sequence
  Description of Artificial Sequence: Synthetic peptide
  Seed: LGTHTMEVTVYHRRGSRSYVPLAHS (PMEL_HUMAN)
  Core: SRSYVPLAH
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVYHRRGXRSXVXLAXS

SEQ ID NO: 330880 - protein, 25 aa, Artificial Sequence
  Description of Artificial Sequence: Synthetic peptide
  Seed: LGTHTMEVTVYHRRGSRSYVPLAHS (PMEL_HUMAN)
  Core: RSYVPLAHS
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LGTHTMEVTVYHRRGSXSYXPXAHX

SEQ ID NO: 330881 - protein, 14 aa, Artificial Sequence
  Description of Artificial Sequence: Synthetic peptide
  Seed: LGVSRQLRTKAWNR (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNR

SEQ ID NO: 330882 - protein, 15 aa, Artificial Sequence
  Description of Artificial Sequence: Synthetic peptide
  Seed: LGVSRQLRTKAWNRQ (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQ

SEQ ID NO: 330883 - protein, 15 aa, Artificial Sequence
  Description of Artificial Sequence: Synthetic peptide
  Seed: LGVSRQLRTKAWNRQ (PMEL_HUMAN)
  Core: QLRTKAWNR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRXLRXKXWNXQ

SEQ ID NO: 330884 - protein, 16 aa, Artificial Sequence
  Description of Artificial Sequence: Synthetic peptide
  Seed: LGVSRQLRTKAWNRQL (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQL

SEQ ID NO: 330885 - protein, 16 aa, Artificial Sequence
  Description of Artificial Sequence: Synthetic peptide
  Seed: LGVSRQLRTKAWNRQL (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXL

SEQ ID NO: 330886 - protein, 17 aa, Artificial Sequence
  Description of Artificial Sequence: Synthetic peptide
  Seed: LGVSRQLRTKAWNRQLY (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLY

SEQ ID NO: 330887 - protein, 17 aa, Artificial Sequence
  Description of Artificial Sequence: Synthetic peptide
  Seed: LGVSRQLRTKAWNRQLY (PMEL_HUMAN)
  Core: QLRTKAWNR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRXLRXKXWNXQLY

SEQ ID NO: 330888 - protein, 17 aa, Artificial Sequence
  Description of Artificial Sequence: Synthetic peptide
  Seed: LGVSRQLRTKAWNRQLY (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLY

SEQ ID NO: 330889 - protein, 17 aa, Artificial Sequence
  Description of Artificial Sequence: Synthetic peptide
  Seed: LGVSRQLRTKAWNRQLY (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLX

SEQ ID NO: 330890 - protein, 18 aa, Artificial Sequence
  Description of Artificial Sequence: Synthetic peptide
  Seed: LGVSRQLRTKAWNRQLYP (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYP

SEQ ID NO: 330891 - protein, 18 aa, Artificial Sequence
  Description of Artificial Sequence: Synthetic peptide
  Seed: LGVSRQLRTKAWNRQLYP (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXP

SEQ ID NO: 330892 - protein, 19 aa, Artificial Sequence
  Description of Artificial Sequence: Synthetic peptide
  Seed: LGVSRQLRTKAWNRQLYPE (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPE

SEQ ID NO: 330893 - protein, 19 aa, Artificial Sequence
  Description of Artificial Sequence: Synthetic peptide
  Seed: LGVSRQLRTKAWNRQLYPE (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPE

SEQ ID NO: 330894 - protein, 19 aa, Artificial Sequence
  Description of Artificial Sequence: Synthetic peptide
  Seed: LGVSRQLRTKAWNRQLYPE (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPE

SEQ ID NO: 330895 - protein, 20 aa, Artificial Sequence
  Description of Artificial Sequence: Synthetic peptide
  Seed: LGVSRQLRTKAWNRQLYPEW (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPEW

SEQ ID NO: 330896 - protein, 20 aa, Artificial Sequence
  Description of Artificial Sequence: Synthetic peptide
  Seed: LGVSRQLRTKAWNRQLYPEW (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPEW

SEQ ID NO: 330897 - protein, 20 aa, Artificial Sequence
  Description of Artificial Sequence: Synthetic peptide
  Seed: LGVSRQLRTKAWNRQLYPEW (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPEW

SEQ ID NO: 330898 - protein, 21 aa, Artificial Sequence
  Description of Artificial Sequence: Synthetic peptide
  Seed: LGVSRQLRTKAWNRQLYPEWT (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPEWT

SEQ ID NO: 330899 - protein, 21 aa, Artificial Sequence
  Description of Artificial Sequence: Synthetic peptide
  Seed: LGVSRQLRTKAWNRQLYPEWT (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPEWT

SEQ ID NO: 330900 - protein, 21 aa, Artificial Sequence
  Description of Artificial Sequence: Synthetic peptide
  Seed: LGVSRQLRTKAWNRQLYPEWT (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPEWT

SEQ ID NO: 330901 - protein, 22 aa, Artificial Sequence
  Description of Artificial Sequence: Synthetic peptide
  Seed: LGVSRQLRTKAWNRQLYPEWTE (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPEWTE

SEQ ID NO: 330902 - protein, 22 aa, Artificial Sequence
  Description of Artificial Sequence: Synthetic peptide
  Seed: LGVSRQLRTKAWNRQLYPEWTE (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPEWTE

SEQ ID NO: 330903 - protein, 22 aa, Artificial Sequence
  Description of Artificial Sequence: Synthetic peptide
  Seed: LGVSRQLRTKAWNRQLYPEWTE (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPEWTE

SEQ ID NO: 330904 - protein, 23 aa, Artificial Sequence
  Description of Artificial Sequence: Synthetic peptide
  Seed: LGVSRQLRTKAWNRQLYPEWTEA (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPEWTEA

SEQ ID NO: 330905 - protein, 23 aa, Artificial Sequence
  Description of Artificial Sequence: Synthetic peptide
  Seed: LGVSRQLRTKAWNRQLYPEWTEA (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPEWTEA

SEQ ID NO: 330906 - protein, 23 aa, Artificial Sequence
  Description of Artificial Sequence: Synthetic peptide
  Seed: LGVSRQLRTKAWNRQLYPEWTEA (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPEWTEA

SEQ ID NO: 330907 - protein, 24 aa, Artificial Sequence
  Description of Artificial Sequence: Synthetic peptide
  Seed: LGVSRQLRTKAWNRQLYPEWTEAQ (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPEWTEAQ

SEQ ID NO: 330908 - protein, 24 aa, Artificial Sequence
  Description of Artificial Sequence: Synthetic peptide
  Seed: LGVSRQLRTKAWNRQLYPEWTEAQ (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPEWTEAQ

SEQ ID NO: 330909 - protein, 24 aa, Artificial Sequence
  Description of Artificial Sequence: Synthetic peptide
  Seed: LGVSRQLRTKAWNRQLYPEWTEAQ (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPEWTEAQ

SEQ ID NO: 330910 - protein, 24 aa, Artificial Sequence
  Description of Artificial Sequence: Synthetic peptide
  Seed: LGVSRQLRTKAWNRQLYPEWTEAQ (PMEL_HUMAN)
  Core: NRQLYPEWT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRTKAWXRQXYXEWXEAQ

SEQ ID NO: 330911 - protein, 25 aa, Artificial Sequence
  Description of Artificial Sequence: Synthetic peptide
  Seed: LGVSRQLRTKAWNRQLYPEWTEAQR (PMEL_HUMAN)
  Core: VSRQLRTKA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXSRXLXTKXWNRQLYPEWTEAQR

SEQ ID NO: 330912 - protein, 25 aa, Artificial Sequence
  Description of Artificial Sequence: Synthetic peptide
  Seed: LGVSRQLRTKAWNRQLYPEWTEAQR (PMEL_HUMAN)
  Core: LRTKAWNRQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQXRTXAXNRXLYPEWTEAQR

SEQ ID NO: 330913 - protein, 25 aa, Artificial Sequence
  Description of Artificial Sequence: Synthetic peptide
  Seed: LGVSRQLRTKAWNRQLYPEWTEAQR (PMEL_HUMAN)
  Core: TKAWNRQLY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRXKAXNXQLXPEWTEAQR

SEQ ID NO: 330914 - protein, 25 aa, Artificial Sequence
  Description of Artificial Sequence: Synthetic peptide
  Seed: LGVSRQLRTKAWNRQLYPEWTEAQR (PMEL_HUMAN)
  Core: NRQLYPEWT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRTKAWXRQXYXEWXEAQR

SEQ ID NO: 330915 - protein, 25 aa, Artificial Sequence
  Description of Artificial Sequence: Synthetic peptide
  Seed: LGVSRQLRTKAWNRQLYPEWTEAQR (PMEL_HUMAN)
  Core: LYPEWTEAQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LGVSRQLRTKAWNRQXYPXWXEAXR

SEQ ID NO: 330916 - protein, 15 aa, Artificial Sequence
  Description of Artificial Sequence: Synthetic peptide
  Seed: LHDPSGYLAEADLSY (PMEL_HUMAN)
  Core: PSGYLAEAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LHDXSGXLXEAXLSY

SEQ ID NO: 330917 - protein, 15 aa, Artificial Sequence
  Description of Artificial Sequence: Synthetic peptide
  Seed: LHDPSGYLAEADLSY (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSX

SEQ ID NO: 330918 - protein, 16 aa, Artificial Sequence
  Description of Artificial Sequence: Synthetic peptide
  Seed: LHDPSGYLAEADLSYT (PMEL_HUMAN)
  Core: PSGYLAEAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LHDXSGXLXEAXLSYT

SEQ ID NO: 330919 - protein, 16 aa, Artificial Sequence
  Description of Artificial Sequence: Synthetic peptide
  Seed: LHDPSGYLAEADLSYT (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXT

SEQ ID NO: 330920 - protein, 17 aa, Artificial Sequence
  Description of Artificial Sequence: Synthetic peptide
  Seed: LHDPSGYLAEADLSYTW (PMEL_HUMAN)
  Core: PSGYLAEAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LHDXSGXLXEAXLSYTW

SEQ ID NO: 330921 - protein, 17 aa, Artificial Sequence
  Description of Artificial Sequence: Synthetic peptide
  Seed: LHDPSGYLAEADLSYTW (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTW

SEQ ID NO: 330922 - protein, 19 aa, Artificial Sequence
  Description of Artificial Sequence: Synthetic peptide
  Seed: LHDPSGYLAEADLSYTWDF (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDF

SEQ ID NO: 330923 - protein, 20 aa, Artificial Sequence
  Description of Artificial Sequence: Synthetic peptide
  Seed: LHDPSGYLAEADLSYTWDFG (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDFG

SEQ ID NO: 330924 - protein, 21 aa, Artificial Sequence
  Description of Artificial Sequence: Synthetic peptide
  Seed: LHDPSGYLAEADLSYTWDFGD (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDFGD

SEQ ID NO: 330925 - protein, 22 aa, Artificial Sequence
  Description of Artificial Sequence: Synthetic peptide
  Seed: LHDPSGYLAEADLSYTWDFGDS (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDFGDS

SEQ ID NO: 330926 - protein, 22 aa, Artificial Sequence
  Description of Artificial Sequence: Synthetic peptide
  Seed: LHDPSGYLAEADLSYTWDFGDS (PMEL_HUMAN)
  Core: LSYTWDFGD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGYLAEADXSYXWXFGXS

SEQ ID NO: 330927 - protein, 23 aa, Artificial Sequence
  Description of Artificial Sequence: Synthetic peptide
  Seed: LHDPSGYLAEADLSYTWDFGDSS (PMEL_HUMAN)
  Core: PSGYLAEAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LHDXSGXLXEAXLSYTWDFGDSS

SEQ ID NO: 330928 - protein, 23 aa, Artificial Sequence
  Description of Artificial Sequence: Synthetic peptide
  Seed: LHDPSGYLAEADLSYTWDFGDSS (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDFGDSS

SEQ ID NO: 330929 - protein, 23 aa, Artificial Sequence
  Description of Artificial Sequence: Synthetic peptide
  Seed: LHDPSGYLAEADLSYTWDFGDSS (PMEL_HUMAN)
  Core: LSYTWDFGD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGYLAEADXSYXWXFGXSS

SEQ ID NO: 330930 - protein, 24 aa, Artificial Sequence
  Description of Artificial Sequence: Synthetic peptide
  Seed: LHDPSGYLAEADLSYTWDFGDSSG (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDFGDSSG

SEQ ID NO: 330931 - protein, 24 aa, Artificial Sequence
  Description of Artificial Sequence: Synthetic peptide
  Seed: LHDPSGYLAEADLSYTWDFGDSSG (PMEL_HUMAN)
  Core: LSYTWDFGD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGYLAEADXSYXWXFGXSSG

SEQ ID NO: 330932 - protein, 25 aa, Artificial Sequence
  Description of Artificial Sequence: Synthetic peptide
  Seed: LHDPSGYLAEADLSYTWDFGDSSGT (PMEL_HUMAN)
  Core: YLAEADLSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGXLAXAXLSXTWDFGDSSGT

SEQ ID NO: 330933 - protein, 25 aa, Artificial Sequence
  Description of Artificial Sequence: Synthetic peptide
  Seed: LHDPSGYLAEADLSYTWDFGDSSGT (PMEL_HUMAN)
  Core: LSYTWDFGD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LHDPSGYLAEADXSYXWXFGXSSGT

SEQ ID NO: 330934 - protein, 13 aa, Artificial Sequence
  Description of Artificial Sequence: Synthetic peptide
  Seed: LHLAVIGALLAVG (PMEL_HUMAN)
  Core: LAVIGALLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LHXAVXGXLLXVG

SEQ ID NO: 330935 - protein, 14 aa, Artificial Sequence
  Description of Artificial Sequence: Synthetic peptide
  Seed: LHLAVIGALLAVGA (PMEL_HUMAN)
  Core: LAVIGALLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LHXAVXGXLLXVGA

SEQ ID NO: 330936 - protein, 14 aa, Artificial Sequence
  Description of Artificial Sequence: Synthetic peptide
  Seed: LHLAVIGALLAVGA (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXA

SEQ ID NO: 330937 - protein, 15 aa, Artificial Sequence
  Description of Artificial Sequence: Synthetic peptide
  Seed: LHLAVIGALLAVGAT (PMEL_HUMAN)
  Core: LAVIGALLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LHXAVXGXLLXVGAT

SEQ ID NO: 330938 - protein, 15 aa, Artificial Sequence
  Description of Artificial Sequence: Synthetic peptide
  Seed: LHLAVIGALLAVGAT (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXAT

SEQ ID NO: 330939 - protein, 15 aa, Artificial Sequence
  Description of Artificial Sequence: Synthetic peptide
  Seed: LHLAVIGALLAVGAT (PMEL_HUMAN)
  Core: IGALLAVGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVXGAXLXVGXT

SEQ ID NO: 330940 - protein, 16 aa, Artificial Sequence
  Description of Artificial Sequence: Synthetic peptide
  Seed: LHLAVIGALLAVGATK (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXATK

SEQ ID NO: 330941 - protein, 16 aa, Artificial Sequence
  Description of Artificial Sequence: Synthetic peptide
  Seed: LHLAVIGALLAVGATK (PMEL_HUMAN)
  Core: IGALLAVGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVXGAXLXVGXTK

SEQ ID NO: 330942 - protein, 17 aa, Artificial Sequence
  Description of Artificial Sequence: Synthetic peptide
  Seed: LHLAVIGALLAVGATKV (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXATKV

SEQ ID NO: 330943 - protein, 17 aa, Artificial Sequence
  Description of Artificial Sequence: Synthetic peptide
  Seed: LHLAVIGALLAVGATKV (PMEL_HUMAN)
  Core: IGALLAVGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVXGAXLXVGXTKV

SEQ ID NO: 330944 - protein, 17 aa, Artificial Sequence
  Description of Artificial Sequence: Synthetic peptide
  Seed: LHLAVIGALLAVGATKV (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKX

SEQ ID NO: 330945 - protein, 18 aa, Artificial Sequence
  Description of Artificial Sequence: Synthetic peptide
  Seed: LHLAVIGALLAVGATKVP (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXATKVP

SEQ ID NO: 330946 - protein, 18 aa, Artificial Sequence
  Description of Artificial Sequence: Synthetic peptide
  Seed: LHLAVIGALLAVGATKVP (PMEL_HUMAN)
  Core: IGALLAVGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVXGAXLXVGXTKVP

SEQ ID NO: 330947 - protein, 18 aa, Artificial Sequence
  Description of Artificial Sequence: Synthetic peptide
  Seed: LHLAVIGALLAVGATKVP (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXP

SEQ ID NO: 330948 - protein, 19 aa, Artificial Sequence
  Description of Artificial Sequence: Synthetic peptide
  Seed: LHLAVIGALLAVGATKVPR (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXATKVPR

SEQ ID NO: 330949 - protein, 19 aa, Artificial Sequence
  Description of Artificial Sequence: Synthetic peptide
  Seed: LHLAVIGALLAVGATKVPR (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPR

SEQ ID NO: 330950 - protein, 20 aa, Artificial Sequence
  Description of Artificial Sequence: Synthetic peptide
  Seed: LHLAVIGALLAVGATKVPRN (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXATKVPRN

SEQ ID NO: 330951 - protein, 20 aa, Artificial Sequence
  Description of Artificial Sequence: Synthetic peptide
  Seed: LHLAVIGALLAVGATKVPRN (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPRN

SEQ ID NO: 330952 - protein, 21 aa, Artificial Sequence
  Description of Artificial Sequence: Synthetic peptide
  Seed: LHLAVIGALLAVGATKVPRNQ (PMEL_HUMAN)
  Core: VIGALLAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHLAXIGXLXAVXATKVPRNQ

SEQ ID NO: 330953 - protein, 21 aa, Artificial Sequence
  Description of Artificial Sequence: Synthetic peptide
  Seed: LHLAVIGALLAVGATKVPRNQ (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPRNQ

SEQ ID NO: 330954 - protein, 22 aa, Artificial Sequence
  Description of Artificial Sequence: Synthetic peptide
  Seed: LHLAVIGALLAVGATKVPRNQD (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPRNQD

SEQ ID NO: 330955 - protein, 22 aa, Artificial Sequence
  Description of Artificial Sequence: Synthetic peptide
  Seed: LHLAVIGALLAVGATKVPRNQD (PMEL_HUMAN)
  Core: VGATKVPRN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGALLAXGAXKXPRXQD

SEQ ID NO: 330956 - protein, 23 aa, Artificial Sequence
  Description of Artificial Sequence: Synthetic peptide
  Seed: LHLAVIGALLAVGATKVPRNQDW (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPRNQDW

SEQ ID NO: 330957 - protein, 23 aa, Artificial Sequence
  Description of Artificial Sequence: Synthetic peptide
  Seed: LHLAVIGALLAVGATKVPRNQDW (PMEL_HUMAN)
  Core: VGATKVPRN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGALLAXGAXKXPRXQDW

SEQ ID NO: 330958 - protein, 24 aa, Artificial Sequence
  Description of Artificial Sequence: Synthetic peptide
  Seed: LHLAVIGALLAVGATKVPRNQDWL (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPRNQDWL

SEQ ID NO: 330959 - protein, 24 aa, Artificial Sequence
  Description of Artificial Sequence: Synthetic peptide
  Seed: LHLAVIGALLAVGATKVPRNQDWL (PMEL_HUMAN)
  Core: VGATKVPRN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGALLAXGAXKXPRXQDWL

SEQ ID NO: 330960 - protein, 25 aa, Artificial Sequence
  Description of Artificial Sequence: Synthetic peptide
  Seed: LHLAVIGALLAVGATKVPRNQDWLG (PMEL_HUMAN)
  Core: LLAVGATKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGAXLAXGXTKXPRNQDWLG

SEQ ID NO: 330961 - protein, 25 aa, Artificial Sequence
  Description of Artificial Sequence: Synthetic peptide
  Seed: LHLAVIGALLAVGATKVPRNQDWLG (PMEL_HUMAN)
  Core: VGATKVPRN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHLAVIGALLAXGAXKXPRXQDWLG

SEQ ID NO: 330962 - protein, 14 aa, Artificial Sequence
  Description of Artificial Sequence: Synthetic peptide
  Seed: LHQILKGGSGTYCL (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXL

SEQ ID NO: 330963 - protein, 15 aa, Artificial Sequence
  Description of Artificial Sequence: Synthetic peptide
  Seed: LHQILKGGSGTYCLN (PMEL_HUMAN)
  Core: ILKGGSGTY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LHQXLKXGXGTXCLN

SEQ ID NO: 330964 - protein, 15 aa, Artificial Sequence
  Description of Artificial Sequence: Synthetic peptide
  Seed: LHQILKGGSGTYCLN (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXLN

SEQ ID NO: 330965 - protein, 16 aa, Artificial Sequence
  Description of Artificial Sequence: Synthetic peptide
  Seed: LHQILKGGSGTYCLNV (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXLNV

SEQ ID NO: 330966 - protein, 17 aa, Artificial Sequence
  Description of Artificial Sequence: Synthetic peptide
  Seed: LHQILKGGSGTYCLNVS (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXLNVS

SEQ ID NO: 330967 - protein, 19 aa, Artificial Sequence
  Description of Artificial Sequence: Synthetic peptide
  Seed: LHQILKGGSGTYCLNVSLA (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXLNVSLA

SEQ ID NO: 330968 - protein, 20 aa, Artificial Sequence
  Description of Artificial Sequence: Synthetic peptide
  Seed: LHQILKGGSGTYCLNVSLAD (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXLNVSLAD

SEQ ID NO: 330969 - protein, 20 aa, Artificial Sequence
  Description of Artificial Sequence: Synthetic peptide
  Seed: LHQILKGGSGTYCLNVSLAD (PMEL_HUMAN)
  Core: SGTYCLNVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGXGTXCXNVXLAD

SEQ ID NO: 330970 - protein, 20 aa, Artificial Sequence
  Description of Artificial Sequence: Synthetic peptide
  Seed: LHQILKGGSGTYCLNVSLAD (PMEL_HUMAN)
  Core: YCLNVSLAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGTXCLXVXLAX

SEQ ID NO: 330971 - protein, 21 aa, Artificial Sequence
  Description of Artificial Sequence: Synthetic peptide
  Seed: LHQILKGGSGTYCLNVSLADT (PMEL_HUMAN)
  Core: SGTYCLNVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGXGTXCXNVXLADT

SEQ ID NO: 330972 - protein, 21 aa, Artificial Sequence
  Description of Artificial Sequence: Synthetic peptide
  Seed: LHQILKGGSGTYCLNVSLADT (PMEL_HUMAN)
  Core: YCLNVSLAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGTXCLXVXLAXT

SEQ ID NO: 330973 - protein, 22 aa, Artificial Sequence
  Description of Artificial Sequence: Synthetic peptide
  Seed: LHQILKGGSGTYCLNVSLADTN (PMEL_HUMAN)
  Core: SGTYCLNVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGXGTXCXNVXLADTN

SEQ ID NO: 330974 - protein, 22 aa, Artificial Sequence
  Description of Artificial Sequence: Synthetic peptide
  Seed: LHQILKGGSGTYCLNVSLADTN (PMEL_HUMAN)
  Core: YCLNVSLAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGTXCLXVXLAXTN

SEQ ID NO: 330975 - protein, 23 aa, Artificial Sequence
  Description of Artificial Sequence: Synthetic peptide
  Seed: LHQILKGGSGTYCLNVSLADTNS (PMEL_HUMAN)
  Core: YCLNVSLAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGTXCLXVXLAXTNS

SEQ ID NO: 330976 - protein, 24 aa, Artificial Sequence
  Description of Artificial Sequence: Synthetic peptide
  Seed: LHQILKGGSGTYCLNVSLADTNSL (PMEL_HUMAN)
  Core: TYCLNVSLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGXYCXNXSLXDTNSL

SEQ ID NO: 330977 - protein, 24 aa, Artificial Sequence
  Description of Artificial Sequence: Synthetic peptide
  Seed: LHQILKGGSGTYCLNVSLADTNSL (PMEL_HUMAN)
  Core: YCLNVSLAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGTXCLXVXLAXTNSL

SEQ ID NO: 330978 - protein, 25 aa, Artificial Sequence
  Description of Artificial Sequence: Synthetic peptide
  Seed: LHQILKGGSGTYCLNVSLADTNSLA (PMEL_HUMAN)
  Core: LKGGSGTYC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LHQIXKGXSXTYXLNVSLADTNSLA

SEQ ID NO: 330979 - protein, 25 aa, Artificial Sequence
  Description of Artificial Sequence: Synthetic peptide
  Seed: LHQILKGGSGTYCLNVSLADTNSLA (PMEL_HUMAN)
  Core: TYCLNVSLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGXYCXNXSLXDTNSLA

SEQ ID NO: 330980 - protein, 25 aa, Artificial Sequence
  Description of Artificial Sequence: Synthetic peptide
  Seed: LHQILKGGSGTYCLNVSLADTNSLA (PMEL_HUMAN)
  Core: YCLNVSLAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LHQILKGGSGTXCLXVXLAXTNSLA

SEQ ID NO: 330981 - protein, 13 aa, Artificial Sequence
  Description of Artificial Sequence: Synthetic peptide
  Seed: LIGANASFSIALN (PMEL_HUMAN)
  Core: IGANASFSI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGAXAXFSXALN

SEQ ID NO: 330982 - protein, 13 aa, Artificial Sequence
  Description of Artificial Sequence: Synthetic peptide
  Seed: LIGANASFSIALN (PMEL_HUMAN)
  Core: ANASFSIAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LIGXNAXFXIAXN

SEQ ID NO: 330983 - protein, 13 aa, Artificial Sequence
  Description of Artificial Sequence: Synthetic peptide
  Seed: LIGANASFSIALN (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALX

SEQ ID NO: 330984 - protein, 14 aa, Artificial Sequence
  Description of Artificial Sequence: Synthetic peptide
  Seed: LIGANASFSIALNF (PMEL_HUMAN)
  Core: IGANASFSI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGAXAXFSXALNF

SEQ ID NO: 330985 - protein, 14 aa, Artificial Sequence
  Description of Artificial Sequence: Synthetic peptide
  Seed: LIGANASFSIALNF (PMEL_HUMAN)
  Core: ANASFSIAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LIGXNAXFXIAXNF

SEQ ID NO: 330986 - protein, 14 aa, Artificial Sequence
  Description of Artificial Sequence: Synthetic peptide
  Seed: LIGANASFSIALNF (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXF

SEQ ID NO: 330987 - protein, 15 aa, Artificial Sequence
  Description of Artificial Sequence: Synthetic peptide
  Seed: LIGANASFSIALNFP (PMEL_HUMAN)
  Core: IGANASFSI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGAXAXFSXALNFP

SEQ ID NO: 330988 - protein, 15 aa, Artificial Sequence
  Description of Artificial Sequence: Synthetic peptide
  Seed: LIGANASFSIALNFP (PMEL_HUMAN)
  Core: ANASFSIAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LIGXNAXFXIAXNFP

SEQ ID NO: 330989 - protein, 15 aa, Artificial Sequence
  Description of Artificial Sequence: Synthetic peptide
  Seed: LIGANASFSIALNFP (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFP

SEQ ID NO: 330990 - protein, 15 aa, Artificial Sequence
  Description of Artificial Sequence: Synthetic peptide
  Seed: LIGANASFSIALNFP (PMEL_HUMAN)
  Core: ASFSIALNF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIGANXSFXIXLNXP

SEQ ID NO: 330991 - protein, 16 aa, Artificial Sequence
  Description of Artificial Sequence: Synthetic peptide
  Seed: LIGANASFSIALNFPG (PMEL_HUMAN)
  Core: IGANASFSI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGAXAXFSXALNFPG

SEQ ID NO: 330992 - protein, 16 aa, Artificial Sequence
  Description of Artificial Sequence: Synthetic peptide
  Seed: LIGANASFSIALNFPG (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPG

SEQ ID NO: 330993 - protein, 16 aa, Artificial Sequence
  Description of Artificial Sequence: Synthetic peptide
  Seed: LIGANASFSIALNFPG (PMEL_HUMAN)
  Core: ASFSIALNF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIGANXSFXIXLNXPG

SEQ ID NO: 330994 - protein, 16 aa, Artificial Sequence
  Description of Artificial Sequence: Synthetic peptide
  Seed: LIGANASFSIALNFPG (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPX

SEQ ID NO: 330995 - protein, 17 aa, Artificial Sequence
  Description of Artificial Sequence: Synthetic peptide
  Seed: LIGANASFSIALNFPGS (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGS

SEQ ID NO: 330996 - protein, 17 aa, Artificial Sequence
  Description of Artificial Sequence: Synthetic peptide
  Seed: LIGANASFSIALNFPGS (PMEL_HUMAN)
  Core: ASFSIALNF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIGANXSFXIXLNXPGS

SEQ ID NO: 330997 - protein, 17 aa, Artificial Sequence
  Description of Artificial Sequence: Synthetic peptide
  Seed: LIGANASFSIALNFPGS (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXS

SEQ ID NO: 330998 - protein, 18 aa, Artificial Sequence
  Description of Artificial Sequence: Synthetic peptide
  Seed: LIGANASFSIALNFPGSQ (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQ

SEQ ID NO: 330999 - protein, 18 aa, Artificial Sequence
  Description of Artificial Sequence: Synthetic peptide
  Seed: LIGANASFSIALNFPGSQ (PMEL_HUMAN)
  Core: ASFSIALNF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIGANXSFXIXLNXPGSQ

SEQ ID NO: 331000 - protein, 18 aa, Artificial Sequence
  Description of Artificial Sequence: Synthetic peptide
  Seed: LIGANASFSIALNFPGSQ (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQ

SEQ ID NO: 331001 - protein, 19 aa, Artificial Sequence
  Description of Artificial Sequence: Synthetic peptide
  Seed: LIGANASFSIALNFPGSQK (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQK

SEQ ID NO: 331002 - protein, 19 aa, Artificial Sequence
  Description of Artificial Sequence: Synthetic peptide
  Seed: LIGANASFSIALNFPGSQK (PMEL_HUMAN)
  Core: ASFSIALNF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIGANXSFXIXLNXPGSQK

SEQ ID NO: 331003 - protein, 19 aa, Artificial Sequence
  Description of Artificial Sequence: Synthetic peptide
  Seed: LIGANASFSIALNFPGSQK (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQK

SEQ ID NO: 331004 - protein, 20 aa, Artificial Sequence
  Description of Artificial Sequence: Synthetic peptide
  Seed: LIGANASFSIALNFPGSQKV (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQKV

SEQ ID NO: 331005 - protein, 20 aa, Artificial Sequence
  Description of Artificial Sequence: Synthetic peptide
  Seed: LIGANASFSIALNFPGSQKV (PMEL_HUMAN)
  Core: ASFSIALNF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIGANXSFXIXLNXPGSQKV

SEQ ID NO: 331006 - protein, 20 aa, Artificial Sequence
  Description of Artificial Sequence: Synthetic peptide
  Seed: LIGANASFSIALNFPGSQKV (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQKV

SEQ ID NO: 331007 - protein, 21 aa, Artificial Sequence
  Description of Artificial Sequence: Synthetic peptide
  Seed: LIGANASFSIALNFPGSQKVL (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQKVL

SEQ ID NO: 331008 - protein, 21 aa, Artificial Sequence
  Description of Artificial Sequence: Synthetic peptide
  Seed: LIGANASFSIALNFPGSQKVL (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQKVL

SEQ ID NO: 331009 - protein, 22 aa, Artificial Sequence
  Description of Artificial Sequence: Synthetic peptide
  Seed: LIGANASFSIALNFPGSQKVLP (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQKVLP

SEQ ID NO: 331010 - protein, 22 aa, Artificial Sequence
  Description of Artificial Sequence: Synthetic peptide
  Seed: LIGANASFSIALNFPGSQKVLP (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQKVLP

SEQ ID NO: 331011 - protein, 23 aa, Artificial Sequence
  Description of Artificial Sequence: Synthetic peptide
  Seed: LIGANASFSIALNFPGSQKVLPD (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQKVLPD

SEQ ID NO: 331012 - protein, 23 aa, Artificial Sequence
  Description of Artificial Sequence: Synthetic peptide
  Seed: LIGANASFSIALNFPGSQKVLPD (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQKVLPD

SEQ ID NO: 331013 - protein, 23 aa, Artificial Sequence
  Description of Artificial Sequence: Synthetic peptide
  Seed: LIGANASFSIALNFPGSQKVLPD (PMEL_HUMAN)
  Core: LNFPGSQKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASFSIAXNFXGXQKXLPD

SEQ ID NO: 331014 - protein, 24 aa, Artificial Sequence
  Description of Artificial Sequence: Synthetic peptide
  Seed: LIGANASFSIALNFPGSQKVLPDG (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQKVLPDG

SEQ ID NO: 331015 - protein, 24 aa, Artificial Sequence
  Description of Artificial Sequence: Synthetic peptide
  Seed: LIGANASFSIALNFPGSQKVLPDG (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQKVLPDG

SEQ ID NO: 331016 - protein, 24 aa, Artificial Sequence
  Description of Artificial Sequence: Synthetic peptide
  Seed: LIGANASFSIALNFPGSQKVLPDG (PMEL_HUMAN)
  Core: LNFPGSQKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASFSIAXNFXGXQKXLPDG

SEQ ID NO: 331017 - protein, 25 aa, Artificial Sequence
  Description of Artificial Sequence: Synthetic peptide
  Seed: LIGANASFSIALNFPGSQKVLPDGQ (PMEL_HUMAN)
  Core: NASFSIALN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIGAXASXSXALXFPGSQKVLPDGQ

SEQ ID NO: 331018 - protein, 25 aa, Artificial Sequence
  Description of Artificial Sequence: Synthetic peptide
  Seed: LIGANASFSIALNFPGSQKVLPDGQ (PMEL_HUMAN)
  Core: FSIALNFPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASXSIXLXFPXSQKVLPDGQ

SEQ ID NO: 331019 - protein, 25 aa, Artificial Sequence
  Description of Artificial Sequence: Synthetic peptide
  Seed: LIGANASFSIALNFPGSQKVLPDGQ (PMEL_HUMAN)
  Core: LNFPGSQKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASFSIAXNFXGXQKXLPDGQ

SEQ ID NO: 331020 - protein, 25 aa, Artificial Sequence
  Description of Artificial Sequence: Synthetic peptide
  Seed: LIGANASFSIALNFPGSQKVLPDGQ (PMEL_HUMAN)
  Core: PGSQKVLPD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LIGANASFSIALNFXGSXKXLPXGQ

SEQ ID NO: 331021 - protein, 15 aa, Artificial Sequence
  Description of Artificial Sequence: Synthetic peptide
  Seed: LIMPGQEAGLGQVPL (PMEL_HUMAN)
  Core: QEAGLGQVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGXEAXLXQVXL

SEQ ID NO: 331022 - protein, 16 aa, Artificial Sequence
  Description of Artificial Sequence: Synthetic peptide
  Seed: LIMPGQEAGLGQVPLI (PMEL_HUMAN)
  Core: QEAGLGQVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGXEAXLXQVXLI

SEQ ID NO: 331023 - protein, 16 aa, Artificial Sequence
  Description of Artificial Sequence: Synthetic peptide
  Seed: LIMPGQEAGLGQVPLI (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLX

SEQ ID NO: 331024 - protein, 17 aa, Artificial Sequence
  Description of Artificial Sequence: Synthetic peptide
  Seed: LIMPGQEAGLGQVPLIV (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXV

SEQ ID NO: 331025 - protein, 19 aa, Artificial Sequence
  Description of Artificial Sequence: Synthetic peptide
  Seed: LIMPGQEAGLGQVPLIVGI (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGI

SEQ ID NO: 331026 - protein, 19 aa, Artificial Sequence
  Description of Artificial Sequence: Synthetic peptide
  Seed: LIMPGQEAGLGQVPLIVGI (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXI

SEQ ID NO: 331027 - protein, 20 aa, Artificial Sequence
  Description of Artificial Sequence: Synthetic peptide
  Seed: LIMPGQEAGLGQVPLIVGIL (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGIL

SEQ ID NO: 331028 - protein, 20 aa, Artificial Sequence
  Description of Artificial Sequence: Synthetic peptide
  Seed: LIMPGQEAGLGQVPLIVGIL (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXIL

SEQ ID NO: 331029 - protein, 21 aa, Artificial Sequence
  Description of Artificial Sequence: Synthetic peptide
  Seed: LIMPGQEAGLGQVPLIVGILL (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGILL

SEQ ID NO: 331030 - protein, 21 aa, Artificial Sequence
  Description of Artificial Sequence: Synthetic peptide
  Seed: LIMPGQEAGLGQVPLIVGILL (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXILL

SEQ ID NO: 331031 - protein, 22 aa, Artificial Sequence
  Description of Artificial Sequence: Synthetic peptide
  Seed: LIMPGQEAGLGQVPLIVGILLV (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGILLV

SEQ ID NO: 331032 - protein, 22 aa, Artificial Sequence
  Description of Artificial Sequence: Synthetic peptide
  Seed: LIMPGQEAGLGQVPLIVGILLV (PMEL_HUMAN)
  Core: GLGQVPLIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAXLGXVXLIXGILLV

SEQ ID NO: 331033 - protein, 22 aa, Artificial Sequence
  Description of Artificial Sequence: Synthetic peptide
  Seed: LIMPGQEAGLGQVPLIVGILLV (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXILLV

SEQ ID NO: 331034 - protein, 23 aa, Artificial Sequence
  Description of Artificial Sequence: Synthetic peptide
  Seed: LIMPGQEAGLGQVPLIVGILLVL (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGILLVL

SEQ ID NO: 331035 - protein, 23 aa, Artificial Sequence
  Description of Artificial Sequence: Synthetic peptide
  Seed: LIMPGQEAGLGQVPLIVGILLVL (PMEL_HUMAN)
  Core: GLGQVPLIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAXLGXVXLIXGILLVL

SEQ ID NO: 331036 - protein, 23 aa, Artificial Sequence
  Description of Artificial Sequence: Synthetic peptide
  Seed: LIMPGQEAGLGQVPLIVGILLVL (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXILLVL

SEQ ID NO: 331037 - protein, 24 aa, Artificial Sequence
  Description of Artificial Sequence: Synthetic peptide
  Seed: LIMPGQEAGLGQVPLIVGILLVLM (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGILLVLM

SEQ ID NO: 331038 - protein, 24 aa, Artificial Sequence
  Description of Artificial Sequence: Synthetic peptide
  Seed: LIMPGQEAGLGQVPLIVGILLVLM (PMEL_HUMAN)
  Core: GLGQVPLIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAXLGXVXLIXGILLVLM

SEQ ID NO: 331039 - protein, 24 aa, Artificial Sequence
  Description of Artificial Sequence: Synthetic peptide
  Seed: LIMPGQEAGLGQVPLIVGILLVLM (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXILLVLM

SEQ ID NO: 331040 - protein, 25 aa, Artificial Sequence
  Description of Artificial Sequence: Synthetic peptide
  Seed: LIMPGQEAGLGQVPLIVGILLVLMA (PMEL_HUMAN)
  Core: AGLGQVPLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEXGLXQXPLXVGILLVLMA

SEQ ID NO: 331041 - protein, 25 aa, Artificial Sequence
  Description of Artificial Sequence: Synthetic peptide
  Seed: LIMPGQEAGLGQVPLIVGILLVLMA (PMEL_HUMAN)
  Core: GLGQVPLIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAXLGXVXLIXGILLVLMA

SEQ ID NO: 331042 - protein, 25 aa, Artificial Sequence
  Description of Artificial Sequence: Synthetic peptide
  Seed: LIMPGQEAGLGQVPLIVGILLVLMA (PMEL_HUMAN)
  Core: LGQVPLIVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIMPGQEAGXGQXPXIVXILLVLMA

SEQ ID NO: 331043 - protein, 13 aa, Artificial Sequence
  Description of Artificial Sequence: Synthetic peptide
  Seed: LISRALVVTHTYL (PMEL_HUMAN)
  Core: ISRALVVTH
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXSRXLXVTXTYL

SEQ ID NO: 331044 - protein, 13 aa, Artificial Sequence
  Description of Artificial Sequence: Synthetic peptide
  Seed: LISRALVVTHTYL (PMEL_HUMAN)
  Core: SRALVVTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRAXVXTHXYL

SEQ ID NO: 331045 - protein, 14 aa, Artificial Sequence
  Description of Artificial Sequence: Synthetic peptide
  Seed: LISRALVVTHTYLE (PMEL_HUMAN)
  Core: ISRALVVTH
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXSRXLXVTXTYLE

SEQ ID NO: 331046 - protein, 14 aa, Artificial Sequence
  Description of Artificial Sequence: Synthetic peptide
  Seed: LISRALVVTHTYLE (PMEL_HUMAN)
  Core: SRALVVTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRAXVXTHXYLE

SEQ ID NO: 331047 - protein, 14 aa, Artificial Sequence
  Description of Artificial Sequence: Synthetic peptide
  Seed: LISRALVVTHTYLE (PMEL_HUMAN)
  Core: RALVVTHTY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LISXALXVXHTXLE

SEQ ID NO: 331048 - protein, 14 aa, Artificial Sequence
  Description of Artificial Sequence: Synthetic peptide
  Seed: LISRALVVTHTYLE (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLX

SEQ ID NO: 331049 - protein, 15 aa, Artificial Sequence
  Description of Artificial Sequence: Synthetic peptide
  Seed: LISRALVVTHTYLEP (PMEL_HUMAN)
  Core: ISRALVVTH
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXSRXLXVTXTYLEP

SEQ ID NO: 331050 - protein, 15 aa, Artificial Sequence
  Description of Artificial Sequence: Synthetic peptide
  Seed: LISRALVVTHTYLEP (PMEL_HUMAN)
  Core: RALVVTHTY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LISXALXVXHTXLEP

SEQ ID NO: 331051 - protein, 15 aa, Artificial Sequence
  Description of Artificial Sequence: Synthetic peptide
  Seed: LISRALVVTHTYLEP (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXP

SEQ ID NO: 331052 - protein, 15 aa, Artificial Sequence
  Description of Artificial Sequence: Synthetic peptide
  Seed: LISRALVVTHTYLEP (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEX

SEQ ID NO: 331053 - protein, 16 aa, Artificial Sequence
  Description of Artificial Sequence: Synthetic peptide
  Seed: LISRALVVTHTYLEPG (PMEL_HUMAN)
  Core: SRALVVTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRAXVXTHXYLEPG

SEQ ID NO: 331054 - protein, 16 aa, Artificial Sequence
  Description of Artificial Sequence: Synthetic peptide
  Seed: LISRALVVTHTYLEPG (PMEL_HUMAN)
  Core: RALVVTHTY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LISXALXVXHTXLEPG

SEQ ID NO: 331055 - protein, 16 aa, Artificial Sequence
  Description of Artificial Sequence: Synthetic peptide
  Seed: LISRALVVTHTYLEPG (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPG

SEQ ID NO: 331056 - protein, 16 aa, Artificial Sequence
  Description of Artificial Sequence: Synthetic peptide
  Seed: LISRALVVTHTYLEPG (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXG

SEQ ID NO: 331057 - protein, 16 aa, Artificial Sequence
  Description of Artificial Sequence: Synthetic peptide
  Seed: LISRALVVTHTYLEPG (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPX

SEQ ID NO: 331058 - protein, 17 aa, Artificial Sequence
  Description of Artificial Sequence: Synthetic peptide
  Seed: LISRALVVTHTYLEPGP (PMEL_HUMAN)
  Core: SRALVVTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRAXVXTHXYLEPGP

SEQ ID NO: 331059 - protein, 17 aa, Artificial Sequence
  Description of Artificial Sequence: Synthetic peptide
  Seed: LISRALVVTHTYLEPGP (PMEL_HUMAN)
  Core: RALVVTHTY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LISXALXVXHTXLEPGP

SEQ ID NO: 331060 - protein, 17 aa, Artificial Sequence
  Description of Artificial Sequence: Synthetic peptide
  Seed: LISRALVVTHTYLEPGP (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGP

SEQ ID NO: 331061 - protein, 17 aa, Artificial Sequence
  Description of Artificial Sequence: Synthetic peptide
  Seed: LISRALVVTHTYLEPGP (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGP

SEQ ID NO: 331062 - protein, 17 aa, Artificial Sequence
  Description of Artificial Sequence: Synthetic peptide
  Seed: LISRALVVTHTYLEPGP (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXP

SEQ ID NO: 331063 - protein, 18 aa, Artificial Sequence
  Description of Artificial Sequence: Synthetic peptide
  Seed: LISRALVVTHTYLEPGPV (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPV

SEQ ID NO: 331064 - protein, 18 aa, Artificial Sequence
  Description of Artificial Sequence: Synthetic peptide
  Seed: LISRALVVTHTYLEPGPV (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPV

SEQ ID NO: 331065 - protein, 18 aa, Artificial Sequence
  Description of Artificial Sequence: Synthetic peptide
  Seed: LISRALVVTHTYLEPGPV (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPV

SEQ ID NO: 331066 - protein, 19 aa, Artificial Sequence
  Description of Artificial Sequence: Synthetic peptide
  Seed: LISRALVVTHTYLEPGPVT (PMEL_HUMAN)
  Core: SRALVVTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRAXVXTHXYLEPGPVT

SEQ ID NO: 331067 - protein, 19 aa, Artificial Sequence
  Description of Artificial Sequence: Synthetic peptide
  Seed: LISRALVVTHTYLEPGPVT (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVT

SEQ ID NO: 331068 - protein, 19 aa, Artificial Sequence
  Description of Artificial Sequence: Synthetic peptide
  Seed: LISRALVVTHTYLEPGPVT (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVT

SEQ ID NO: 331069 - protein, 19 aa, Artificial Sequence
  Description of Artificial Sequence: Synthetic peptide
  Seed: LISRALVVTHTYLEPGPVT (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVT

SEQ ID NO: 331070 - protein, 20 aa, Artificial Sequence
  Description of Artificial Sequence: Synthetic peptide
  Seed: LISRALVVTHTYLEPGPVTA (PMEL_HUMAN)
  Core: SRALVVTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRAXVXTHXYLEPGPVTA

SEQ ID NO: 331071 - protein, 20 aa, Artificial Sequence
  Description of Artificial Sequence: Synthetic peptide
  Seed: LISRALVVTHTYLEPGPVTA (PMEL_HUMAN)
  Core: RALVVTHTY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LISXALXVXHTXLEPGPVTA

SEQ ID NO: 331072 - protein, 20 aa, Artificial Sequence
  Description of Artificial Sequence: Synthetic peptide
  Seed: LISRALVVTHTYLEPGPVTA (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVTA

SEQ ID NO: 331073 - protein, 20 aa, Artificial Sequence
  Description of Artificial Sequence: Synthetic peptide
  Seed: LISRALVVTHTYLEPGPVTA (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVTA

SEQ ID NO: 331074 - protein, 20 aa, Artificial Sequence
  Description of Artificial Sequence: Synthetic peptide
  Seed: LISRALVVTHTYLEPGPVTA (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVTA

SEQ ID NO: 331075 - protein, 20 aa, Artificial Sequence
  Description of Artificial Sequence: Synthetic peptide
  Seed: LISRALVVTHTYLEPGPVTA (PMEL_HUMAN)
  Core: HTYLEPGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTXTYXEXGPXTA

SEQ ID NO: 331076 - protein, 21 aa, Artificial Sequence
  Description of Artificial Sequence: Synthetic peptide
  Seed: LISRALVVTHTYLEPGPVTAQ (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVTAQ

SEQ ID NO: 331077 - protein, 21 aa, Artificial Sequence
  Description of Artificial Sequence: Synthetic peptide
  Seed: LISRALVVTHTYLEPGPVTAQ (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVTAQ

SEQ ID NO: 331078 - protein, 21 aa, Artificial Sequence
  Description of Artificial Sequence: Synthetic peptide
  Seed: LISRALVVTHTYLEPGPVTAQ (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVTAQ

SEQ ID NO: 331079 - protein, 21 aa, Artificial Sequence
  Description of Artificial Sequence: Synthetic peptide
  Seed: LISRALVVTHTYLEPGPVTAQ (PMEL_HUMAN)
  Core: HTYLEPGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTXTYXEXGPXTAQ

SEQ ID NO: 331080 - protein, 22 aa, Artificial Sequence
  Description of Artificial Sequence: Synthetic peptide
  Seed: LISRALVVTHTYLEPGPVTAQV (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVTAQV

SEQ ID NO: 331081 - protein, 22 aa, Artificial Sequence
  Description of Artificial Sequence: Synthetic peptide
  Seed: LISRALVVTHTYLEPGPVTAQV (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVTAQV

SEQ ID NO: 331082 - protein, 22 aa, Artificial Sequence
  Description of Artificial Sequence: Synthetic peptide
  Seed: LISRALVVTHTYLEPGPVTAQV (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVTAQV

SEQ ID NO: 331083 - protein, 22 aa, Artificial Sequence
  Description of Artificial Sequence: Synthetic peptide
  Seed: LISRALVVTHTYLEPGPVTAQV (PMEL_HUMAN)
  Core: HTYLEPGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTXTYXEXGPXTAQV

SEQ ID NO: 331084 - protein, 23 aa, Artificial Sequence
  Description of Artificial Sequence: Synthetic peptide
  Seed: LISRALVVTHTYLEPGPVTAQVV (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVTAQVV

SEQ ID NO: 331085 - protein, 23 aa, Artificial Sequence
  Description of Artificial Sequence: Synthetic peptide
  Seed: LISRALVVTHTYLEPGPVTAQVV (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVTAQVV

SEQ ID NO: 331086 - protein, 23 aa, Artificial Sequence
  Description of Artificial Sequence: Synthetic peptide
  Seed: LISRALVVTHTYLEPGPVTAQVV (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVTAQVV

SEQ ID NO: 331087 - protein, 23 aa, Artificial Sequence
  Description of Artificial Sequence: Synthetic peptide
  Seed: LISRALVVTHTYLEPGPVTAQVV (PMEL_HUMAN)
  Core: HTYLEPGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTXTYXEXGPXTAQVV

SEQ ID NO: 331088 - protein, 24 aa, Artificial Sequence
  Description of Artificial Sequence: Synthetic peptide
  Seed: LISRALVVTHTYLEPGPVTAQVVL (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVTAQVVL

SEQ ID NO: 331089 - protein, 24 aa, Artificial Sequence
  Description of Artificial Sequence: Synthetic peptide
  Seed: LISRALVVTHTYLEPGPVTAQVVL (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVTAQVVL

SEQ ID NO: 331090 - protein, 24 aa, Artificial Sequence
  Description of Artificial Sequence: Synthetic peptide
  Seed: LISRALVVTHTYLEPGPVTAQVVL (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVTAQVVL

SEQ ID NO: 331091 - protein, 24 aa, Artificial Sequence
  Description of Artificial Sequence: Synthetic peptide
  Seed: LISRALVVTHTYLEPGPVTAQVVL (PMEL_HUMAN)
  Core: HTYLEPGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTXTYXEXGPXTAQVVL

SEQ ID NO: 331092 - protein, 25 aa, Artificial Sequence
  Description of Artificial Sequence: Synthetic peptide
  Seed: LISRALVVTHTYLEPGPVTAQVVLQ (PMEL_HUMAN)
  Core: LVVTHTYLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LISRAXVVXHXYLXPGPVTAQVVLQ

SEQ ID NO: 331093 - protein, 25 aa, Artificial Sequence
  Description of Artificial Sequence: Synthetic peptide
  Seed: LISRALVVTHTYLEPGPVTAQVVLQ (PMEL_HUMAN)
  Core: VVTHTYLEP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LISRALXVTXTXLEXGPVTAQVVLQ

SEQ ID NO: 331094 - protein, 25 aa, Artificial Sequence
  Description of Artificial Sequence: Synthetic peptide
  Seed: LISRALVVTHTYLEPGPVTAQVVLQ (PMEL_HUMAN)
  Core: VTHTYLEPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVXTHXYXEPXPVTAQVVLQ

SEQ ID NO: 331095 - protein, 25 aa, Artificial Sequence
  Description of Artificial Sequence: Synthetic peptide
  Seed: LISRALVVTHTYLEPGPVTAQVVLQ (PMEL_HUMAN)
  Core: HTYLEPGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTXTYXEXGPXTAQVVLQ

SEQ ID NO: 331096 - protein, 25 aa, Artificial Sequence
  Description of Artificial Sequence: Synthetic peptide
  Seed: LISRALVVTHTYLEPGPVTAQVVLQ (PMEL_HUMAN)
  Core: PVTAQVVLQ
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LISRALVVTHTYLEPGXVTXQXVLX

SEQ ID NO: 331097 - protein, 15 aa, Artificial Sequence
  Description of Artificial Sequence: Synthetic peptide
  Seed: LIVGILLVLMAVVLA (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXA

SEQ ID NO: 331098 - protein, 16 aa, Artificial Sequence
  Description of Artificial Sequence: Synthetic peptide
  Seed: LIVGILLVLMAVVLAS (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXAS

SEQ ID NO: 331099 - protein, 16 aa, Artificial Sequence
  Description of Artificial Sequence: Synthetic peptide
  Seed: LIVGILLVLMAVVLAS (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXS

SEQ ID NO: 331100 - protein, 17 aa, Artificial Sequence
  Description of Artificial Sequence: Synthetic peptide
  Seed: LIVGILLVLMAVVLASL (PMEL_HUMAN)
  Core: ILLVLMAVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIVGXLLXLXAVXLASL

SEQ ID NO: 331101 - protein, 17 aa, Artificial Sequence
  Description of Artificial Sequence: Synthetic peptide
  Seed: LIVGILLVLMAVVLASL (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASL

SEQ ID NO: 331102 - protein, 17 aa, Artificial Sequence
  Description of Artificial Sequence: Synthetic peptide
  Seed: LIVGILLVLMAVVLASL (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSL

SEQ ID NO: 331103 - protein, 18 aa, Artificial Sequence
  Description of Artificial Sequence: Synthetic peptide
  Seed: LIVGILLVLMAVVLASLI (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLI

SEQ ID NO: 331104 - protein, 19 aa, Artificial Sequence
  Description of Artificial Sequence: Synthetic peptide
  Seed: LIVGILLVLMAVVLASLIY (PMEL_HUMAN)
  Core: ILLVLMAVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIVGXLLXLXAVXLASLIY

SEQ ID NO: 331105 - protein, 19 aa, Artificial Sequence
  Description of Artificial Sequence: Synthetic peptide
  Seed: LIVGILLVLMAVVLASLIY (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIY

SEQ ID NO: 331106 - protein, 19 aa, Artificial Sequence
  Description of Artificial Sequence: Synthetic peptide
  Seed: LIVGILLVLMAVVLASLIY (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIY

SEQ ID NO: 331107 - protein, 20 aa, Artificial Sequence
  Description of Artificial Sequence: Synthetic peptide
  Seed: LIVGILLVLMAVVLASLIYR (PMEL_HUMAN)
  Core: ILLVLMAVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIVGXLLXLXAVXLASLIYR

SEQ ID NO: 331108 - protein, 20 aa, Artificial Sequence
  Description of Artificial Sequence: Synthetic peptide
  Seed: LIVGILLVLMAVVLASLIYR (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIYR

SEQ ID NO: 331109 - protein, 20 aa, Artificial Sequence
  Description of Artificial Sequence: Synthetic peptide
  Seed: LIVGILLVLMAVVLASLIYR (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSLIYR

SEQ ID NO: 331110 - protein, 20 aa, Artificial Sequence
  Description of Artificial Sequence: Synthetic peptide
  Seed: LIVGILLVLMAVVLASLIYR (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIYR

SEQ ID NO: 331111 - protein, 20 aa, Artificial Sequence
  Description of Artificial Sequence: Synthetic peptide
  Seed: LIVGILLVLMAVVLASLIYR (PMEL_HUMAN)
  Core: LMAVVLASL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVXMAXVXASXIYR

SEQ ID NO: 331112 - protein, 20 aa, Artificial Sequence
  Description of Artificial Sequence: Synthetic peptide
  Seed: LIVGILLVLMAVVLASLIYR (PMEL_HUMAN)
  Core: MAVVLASLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLXAVXLXSLXYR

SEQ ID NO: 331113 - protein, 21 aa, Artificial Sequence
  Description of Artificial Sequence: Synthetic peptide
  Seed: LIVGILLVLMAVVLASLIYRR (PMEL_HUMAN)
  Core: ILLVLMAVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIVGXLLXLXAVXLASLIYRR

SEQ ID NO: 331114 - protein, 21 aa, Artificial Sequence
  Description of Artificial Sequence: Synthetic peptide
  Seed: LIVGILLVLMAVVLASLIYRR (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIYRR

SEQ ID NO: 331115 - protein, 21 aa, Artificial Sequence
  Description of Artificial Sequence: Synthetic peptide
  Seed: LIVGILLVLMAVVLASLIYRR (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSLIYRR

SEQ ID NO: 331116 - protein, 21 aa, Artificial Sequence
  Description of Artificial Sequence: Synthetic peptide
  Seed: LIVGILLVLMAVVLASLIYRR (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIYRR

SEQ ID NO: 331117 - protein, 21 aa, Artificial Sequence
  Description of Artificial Sequence: Synthetic peptide
  Seed: LIVGILLVLMAVVLASLIYRR (PMEL_HUMAN)
  Core: LMAVVLASL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVXMAXVXASXIYRR

SEQ ID NO: 331118 - protein, 21 aa, Artificial Sequence
  Description of Artificial Sequence: Synthetic peptide
  Seed: LIVGILLVLMAVVLASLIYRR (PMEL_HUMAN)
  Core: MAVVLASLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLXAVXLXSLXYRR

SEQ ID NO: 331119 - protein, 21 aa, Artificial Sequence
  Description of Artificial Sequence: Synthetic peptide
  Seed: LIVGILLVLMAVVLASLIYRR (PMEL_HUMAN)
  Core: VVLASLIYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAXVLXSXIYXR

SEQ ID NO: 331120 - protein, 22 aa, Artificial Sequence
  Description of Artificial Sequence: Synthetic peptide
  Seed: LIVGILLVLMAVVLASLIYRRR (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIYRRR

SEQ ID NO: 331121 - protein, 22 aa, Artificial Sequence
  Description of Artificial Sequence: Synthetic peptide
  Seed: LIVGILLVLMAVVLASLIYRRR (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSLIYRRR

SEQ ID NO: 331122 - protein, 22 aa, Artificial Sequence
  Description of Artificial Sequence: Synthetic peptide
  Seed: LIVGILLVLMAVVLASLIYRRR (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIYRRR

SEQ ID NO: 331123 - protein, 22 aa, Artificial Sequence
  Description of Artificial Sequence: Synthetic peptide
  Seed: LIVGILLVLMAVVLASLIYRRR (PMEL_HUMAN)
  Core: MAVVLASLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLXAVXLXSLXYRRR

SEQ ID NO: 331124 - protein, 22 aa, Artificial Sequence
  Description of Artificial Sequence: Synthetic peptide
  Seed: LIVGILLVLMAVVLASLIYRRR (PMEL_HUMAN)
  Core: AVVLASLIY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMXVVXAXLIXRRR

SEQ ID NO: 331125 - protein, 22 aa, Artificial Sequence
  Description of Artificial Sequence: Synthetic peptide
  Seed: LIVGILLVLMAVVLASLIYRRR (PMEL_HUMAN)
  Core: VVLASLIYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAXVLXSXIYXRR

SEQ ID NO: 331126 - protein, 22 aa, Artificial Sequence
  Description of Artificial Sequence: Synthetic peptide
  Seed: LIVGILLVLMAVVLASLIYRRR (PMEL_HUMAN)
  Core: VLASLIYRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVXLAXLXYRXR

SEQ ID NO: 331127 - protein, 22 aa, Artificial Sequence
  Description of Artificial Sequence: Synthetic peptide
  Seed: LIVGILLVLMAVVLASLIYRRR (PMEL_HUMAN)
  Core: LASLIYRRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVVXASXIXRRX

SEQ ID NO: 331128 - protein, 23 aa, Artificial Sequence
  Description of Artificial Sequence: Synthetic peptide
  Seed: LIVGILLVLMAVVLASLIYRRRL (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIYRRRL

SEQ ID NO: 331129 - protein, 23 aa, Artificial Sequence
  Description of Artificial Sequence: Synthetic peptide
  Seed: LIVGILLVLMAVVLASLIYRRRL (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSLIYRRRL

SEQ ID NO: 331130 - protein, 23 aa, Artificial Sequence
  Description of Artificial Sequence: Synthetic peptide
  Seed: LIVGILLVLMAVVLASLIYRRRL (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIYRRRL

SEQ ID NO: 331131 - protein, 23 aa, Artificial Sequence
  Description of Artificial Sequence: Synthetic peptide
  Seed: LIVGILLVLMAVVLASLIYRRRL (PMEL_HUMAN)
  Core: MAVVLASLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLXAVXLXSLXYRRRL

SEQ ID NO: 331132 - protein, 23 aa, Artificial Sequence
  Description of Artificial Sequence: Synthetic peptide
  Seed: LIVGILLVLMAVVLASLIYRRRL (PMEL_HUMAN)
  Core: AVVLASLIY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMXVVXAXLIXRRRL

SEQ ID NO: 331133 - protein, 23 aa, Artificial Sequence
  Description of Artificial Sequence: Synthetic peptide
  Seed: LIVGILLVLMAVVLASLIYRRRL (PMEL_HUMAN)
  Core: VVLASLIYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAXVLXSXIYXRRL

SEQ ID NO: 331134 - protein, 23 aa, Artificial Sequence
  Description of Artificial Sequence: Synthetic peptide
  Seed: LIVGILLVLMAVVLASLIYRRRL (PMEL_HUMAN)
  Core: VLASLIYRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVXLAXLXYRXRL

SEQ ID NO: 331135 - protein, 23 aa, Artificial Sequence
  Description of Artificial Sequence: Synthetic peptide
  Seed: LIVGILLVLMAVVLASLIYRRRL (PMEL_HUMAN)
  Core: LASLIYRRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVVXASXIXRRXL

SEQ ID NO: 331136 - protein, 24 aa, Artificial Sequence
  Description of Artificial Sequence: Synthetic peptide
  Seed: LIVGILLVLMAVVLASLIYRRRLM (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIYRRRLM

SEQ ID NO: 331137 - protein, 24 aa, Artificial Sequence
  Description of Artificial Sequence: Synthetic peptide
  Seed: LIVGILLVLMAVVLASLIYRRRLM (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSLIYRRRLM

SEQ ID NO: 331138 - protein, 24 aa, Artificial Sequence
  Description of Artificial Sequence: Synthetic peptide
  Seed: LIVGILLVLMAVVLASLIYRRRLM (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIYRRRLM

SEQ ID NO: 331139 - protein, 24 aa, Artificial Sequence
  Description of Artificial Sequence: Synthetic peptide
  Seed: LIVGILLVLMAVVLASLIYRRRLM (PMEL_HUMAN)
  Core: LMAVVLASL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVXMAXVXASXIYRRRLM

SEQ ID NO: 331140 - protein, 24 aa, Artificial Sequence
  Description of Artificial Sequence: Synthetic peptide
  Seed: LIVGILLVLMAVVLASLIYRRRLM (PMEL_HUMAN)
  Core: MAVVLASLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLXAVXLXSLXYRRRLM

SEQ ID NO: 331141 - protein, 24 aa, Artificial Sequence
  Description of Artificial Sequence: Synthetic peptide
  Seed: LIVGILLVLMAVVLASLIYRRRLM (PMEL_HUMAN)
  Core: AVVLASLIY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMXVVXAXLIXRRRLM

SEQ ID NO: 331142 - protein, 24 aa, Artificial Sequence
  Description of Artificial Sequence: Synthetic peptide
  Seed: LIVGILLVLMAVVLASLIYRRRLM (PMEL_HUMAN)
  Core: VVLASLIYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAXVLXSXIYXRRLM

SEQ ID NO: 331143 - protein, 24 aa, Artificial Sequence
  Description of Artificial Sequence: Synthetic peptide
  Seed: LIVGILLVLMAVVLASLIYRRRLM (PMEL_HUMAN)
  Core: VLASLIYRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVXLAXLXYRXRLM

SEQ ID NO: 331144 - protein, 24 aa, Artificial Sequence
  Description of Artificial Sequence: Synthetic peptide
  Seed: LIVGILLVLMAVVLASLIYRRRLM (PMEL_HUMAN)
  Core: LASLIYRRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVVXASXIXRRXLM

SEQ ID NO: 331145 - protein, 25 aa, Artificial Sequence
  Description of Artificial Sequence: Synthetic peptide
  Seed: LIVGILLVLMAVVLASLIYRRRLMK (PMEL_HUMAN)
  Core: LLVLMAVVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIVGIXLVXMXVVXASLIYRRRLMK

SEQ ID NO: 331146 - protein, 25 aa, Artificial Sequence
  Description of Artificial Sequence: Synthetic peptide
  Seed: LIVGILLVLMAVVLASLIYRRRLMK (PMEL_HUMAN)
  Core: LVLMAVVLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILXVLXAXVLXSLIYRRRLMK

SEQ ID NO: 331147 - protein, 25 aa, Artificial Sequence
  Description of Artificial Sequence: Synthetic peptide
  Seed: LIVGILLVLMAVVLASLIYRRRLMK (PMEL_HUMAN)
  Core: VLMAVVLAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLXLMXVXLAXLIYRRRLMK

SEQ ID NO: 331148 - protein, 25 aa, Artificial Sequence
  Description of Artificial Sequence: Synthetic peptide
  Seed: LIVGILLVLMAVVLASLIYRRRLMK (PMEL_HUMAN)
  Core: MAVVLASLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLXAVXLXSLXYRRRLMK

SEQ ID NO: 331149 - protein, 25 aa, Artificial Sequence
  Description of Artificial Sequence: Synthetic peptide
  Seed: LIVGILLVLMAVVLASLIYRRRLMK (PMEL_HUMAN)
  Core: AVVLASLIY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMXVVXAXLIXRRRLMK

SEQ ID NO: 331150 - protein, 25 aa, Artificial Sequence
  Description of Artificial Sequence: Synthetic peptide
  Seed: LIVGILLVLMAVVLASLIYRRRLMK (PMEL_HUMAN)
  Core: VVLASLIYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAXVLXSXIYXRRLMK

SEQ ID NO: 331151 - protein, 25 aa, Artificial Sequence
  Description of Artificial Sequence: Synthetic peptide
  Seed: LIVGILLVLMAVVLASLIYRRRLMK (PMEL_HUMAN)
  Core: VLASLIYRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVXLAXLXYRXRLMK

SEQ ID NO: 331152 - protein, 25 aa, Artificial Sequence
  Description of Artificial Sequence: Synthetic peptide
  Seed: LIVGILLVLMAVVLASLIYRRRLMK (PMEL_HUMAN)
  Core: LASLIYRRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LIVGILLVLMAVVXASXIXRRXLMK

SEQ ID NO: 331153 - protein, 13 aa, Artificial Sequence
  Description of Artificial Sequence: Synthetic peptide
  Seed: LIYRRRLMKQDFS (PMEL_HUMAN)
  Core: IYRRRLMKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXYRXRXMKXDFS

SEQ ID NO: 331154 - protein, 14 aa, Artificial Sequence
  Description of Artificial Sequence: Synthetic peptide
  Seed: LIYRRRLMKQDFSV (PMEL_HUMAN)
  Core: IYRRRLMKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXYRXRXMKXDFSV

SEQ ID NO: 331155 - protein, 14 aa, Artificial Sequence
  Description of Artificial Sequence: Synthetic peptide
  Seed: LIYRRRLMKQDFSV (PMEL_HUMAN)
  Core: YRRRLMKQD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRRXLXKQXFSV

SEQ ID NO: 331156 - protein, 14 aa, Artificial Sequence
  Description of Artificial Sequence: Synthetic peptide
  Seed: LIYRRRLMKQDFSV (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXV

SEQ ID NO: 331157 - protein, 15 aa, Artificial Sequence
  Description of Artificial Sequence: Synthetic peptide
  Seed: LIYRRRLMKQDFSVP (PMEL_HUMAN)
  Core: IYRRRLMKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXYRXRXMKXDFSVP

SEQ ID NO: 331158 - protein, 15 aa, Artificial Sequence
  Description of Artificial Sequence: Synthetic peptide
  Seed: LIYRRRLMKQDFSVP (PMEL_HUMAN)
  Core: YRRRLMKQD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRRXLXKQXFSVP

SEQ ID NO: 331159 - protein, 15 aa, Artificial Sequence
  Description of Artificial Sequence: Synthetic peptide
  Seed: LIYRRRLMKQDFSVP (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXVP

SEQ ID NO: 331160 - protein, 15 aa, Artificial Sequence
  Description of Artificial Sequence: Synthetic peptide
  Seed: LIYRRRLMKQDFSVP (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXP

SEQ ID NO: 331161 - protein, 16 aa, Artificial Sequence
  Description of Artificial Sequence: Synthetic peptide
  Seed: LIYRRRLMKQDFSVPQ (PMEL_HUMAN)
  Core: IYRRRLMKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXYRXRXMKXDFSVPQ

SEQ ID NO: 331162 - protein, 16 aa, Artificial Sequence
  Description of Artificial Sequence: Synthetic peptide
  Seed: LIYRRRLMKQDFSVPQ (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXVPQ

SEQ ID NO: 331163 - protein, 16 aa, Artificial Sequence
  Description of Artificial Sequence: Synthetic peptide
  Seed: LIYRRRLMKQDFSVPQ (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXPQ

SEQ ID NO: 331164 - protein, 16 aa, Artificial Sequence
  Description of Artificial Sequence: Synthetic peptide
  Seed: LIYRRRLMKQDFSVPQ (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQ

SEQ ID NO: 331165 - protein, 16 aa, Artificial Sequence
  Description of Artificial Sequence: Synthetic peptide
  Seed: LIYRRRLMKQDFSVPQ (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPX

SEQ ID NO: 331166 - protein, 17 aa, Artificial Sequence
  Description of Artificial Sequence: Synthetic peptide
  Seed: LIYRRRLMKQDFSVPQL (PMEL_HUMAN)
  Core: YRRRLMKQD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LIXRRXLXKQXFSVPQL

SEQ ID NO: 331167 - protein, 17 aa, Artificial Sequence
  Description of Artificial Sequence: Synthetic peptide
  Seed: LIYRRRLMKQDFSVPQL (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXVPQL

SEQ ID NO: 331168 - protein, 17 aa, Artificial Sequence
  Description of Artificial Sequence: Synthetic peptide
  Seed: LIYRRRLMKQDFSVPQL (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXPQL

SEQ ID NO: 331169 - protein, 17 aa, Artificial Sequence
  Description of Artificial Sequence: Synthetic peptide
  Seed: LIYRRRLMKQDFSVPQL (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQL

SEQ ID NO: 331170 - protein, 17 aa, Artificial Sequence
  Description of Artificial Sequence: Synthetic peptide
  Seed: LIYRRRLMKQDFSVPQL (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXL

SEQ ID NO: 331171 - protein, 18 aa, Artificial Sequence
  Description of Artificial Sequence: Synthetic peptide
  Seed: LIYRRRLMKQDFSVPQLP (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLP

SEQ ID NO: 331172 - protein, 18 aa, Artificial Sequence
  Description of Artificial Sequence: Synthetic peptide
  Seed: LIYRRRLMKQDFSVPQLP (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLP

SEQ ID NO: 331173 - protein, 19 aa, Artificial Sequence
  Description of Artificial Sequence: Synthetic peptide
  Seed: LIYRRRLMKQDFSVPQLPH (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXVPQLPH

SEQ ID NO: 331174 - protein, 19 aa, Artificial Sequence
  Description of Artificial Sequence: Synthetic peptide
  Seed: LIYRRRLMKQDFSVPQLPH (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXPQLPH

SEQ ID NO: 331175 - protein, 19 aa, Artificial Sequence
  Description of Artificial Sequence: Synthetic peptide
  Seed: LIYRRRLMKQDFSVPQLPH (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPH

SEQ ID NO: 331176 - protein, 19 aa, Artificial Sequence
  Description of Artificial Sequence: Synthetic peptide
  Seed: LIYRRRLMKQDFSVPQLPH (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPH

SEQ ID NO: 331177 - protein, 20 aa, Artificial Sequence
  Description of Artificial Sequence: Synthetic peptide
  Seed: LIYRRRLMKQDFSVPQLPHS (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXVPQLPHS

SEQ ID NO: 331178 - protein, 20 aa, Artificial Sequence
  Description of Artificial Sequence: Synthetic peptide
  Seed: LIYRRRLMKQDFSVPQLPHS (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXPQLPHS

SEQ ID NO: 331179 - protein, 20 aa, Artificial Sequence
  Description of Artificial Sequence: Synthetic peptide
  Seed: LIYRRRLMKQDFSVPQLPHS (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPHS

SEQ ID NO: 331180 - protein, 20 aa, Artificial Sequence
  Description of Artificial Sequence: Synthetic peptide
  Seed: LIYRRRLMKQDFSVPQLPHS (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPHS

SEQ ID NO: 331181 - protein, 20 aa, Artificial Sequence
  Description of Artificial Sequence: Synthetic peptide
  Seed: LIYRRRLMKQDFSVPQLPHS (PMEL_HUMAN)
  Core: KQDFSVPQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMXQDXSXPQXPHS

SEQ ID NO: 331182 - protein, 21 aa, Artificial Sequence
  Description of Artificial Sequence: Synthetic peptide
  Seed: LIYRRRLMKQDFSVPQLPHSS (PMEL_HUMAN)
  Core: RRLMKQDFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LIYRXRLXKXDFXVPQLPHSS

SEQ ID NO: 331183 - protein, 21 aa, Artificial Sequence
  Description of Artificial Sequence: Synthetic peptide
  Seed: LIYRRRLMKQDFSVPQLPHSS (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXPQLPHSS

SEQ ID NO: 331184 - protein, 21 aa, Artificial Sequence
  Description of Artificial Sequence: Synthetic peptide
  Seed: LIYRRRLMKQDFSVPQLPHSS (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPHSS

SEQ ID NO: 331185 - protein, 21 aa, Artificial Sequence
  Description of Artificial Sequence: Synthetic peptide
  Seed: LIYRRRLMKQDFSVPQLPHSS (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPHSS

SEQ ID NO: 331186 - protein, 21 aa, Artificial Sequence
  Description of Artificial Sequence: Synthetic peptide
  Seed: LIYRRRLMKQDFSVPQLPHSS (PMEL_HUMAN)
  Core: KQDFSVPQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMXQDXSXPQXPHSS

SEQ ID NO: 331187 - protein, 21 aa, Artificial Sequence
  Description of Artificial Sequence: Synthetic peptide
  Seed: LIYRRRLMKQDFSVPQLPHSS (PMEL_HUMAN)
  Core: FSVPQLPHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMKQDXSVXQXPHXS

SEQ ID NO: 331188 - protein, 22 aa, Artificial Sequence
  Description of Artificial Sequence: Synthetic peptide
  Seed: LIYRRRLMKQDFSVPQLPHSSS (PMEL_HUMAN)
  Core: RLMKQDFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRXLMXQXFSXPQLPHSSS

SEQ ID NO: 331189 - protein, 22 aa, Artificial Sequence
  Description of Artificial Sequence: Synthetic peptide
  Seed: LIYRRRLMKQDFSVPQLPHSSS (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPHSSS

SEQ ID NO: 331190 - protein, 22 aa, Artificial Sequence
  Description of Artificial Sequence: Synthetic peptide
  Seed: LIYRRRLMKQDFSVPQLPHSSS (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPHSSS

SEQ ID NO: 331191 - protein, 22 aa, Artificial Sequence
  Description of Artificial Sequence: Synthetic peptide
  Seed: LIYRRRLMKQDFSVPQLPHSSS (PMEL_HUMAN)
  Core: FSVPQLPHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMKQDXSVXQXPHXSS

SEQ ID NO: 331192 - protein, 23 aa, Artificial Sequence
  Description of Artificial Sequence: Synthetic peptide
  Seed: LIYRRRLMKQDFSVPQLPHSSSH (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPHSSSH

SEQ ID NO: 331193 - protein, 23 aa, Artificial Sequence
  Description of Artificial Sequence: Synthetic peptide
  Seed: LIYRRRLMKQDFSVPQLPHSSSH (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPHSSSH

SEQ ID NO: 331194 - protein, 23 aa, Artificial Sequence
  Description of Artificial Sequence: Synthetic peptide
  Seed: LIYRRRLMKQDFSVPQLPHSSSH (PMEL_HUMAN)
  Core: FSVPQLPHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMKQDXSVXQXPHXSSH

SEQ ID NO: 331195 - protein, 24 aa, Artificial Sequence
  Description of Artificial Sequence: Synthetic peptide
  Seed: LIYRRRLMKQDFSVPQLPHSSSHW (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPHSSSHW

SEQ ID NO: 331196 - protein, 24 aa, Artificial Sequence
  Description of Artificial Sequence: Synthetic peptide
  Seed: LIYRRRLMKQDFSVPQLPHSSSHW (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPHSSSHW

SEQ ID NO: 331197 - protein, 24 aa, Artificial Sequence
  Description of Artificial Sequence: Synthetic peptide
  Seed: LIYRRRLMKQDFSVPQLPHSSSHW (PMEL_HUMAN)
  Core: FSVPQLPHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMKQDXSVXQXPHXSSHW

SEQ ID NO: 331198 - protein, 25 aa, Artificial Sequence
  Description of Artificial Sequence: Synthetic peptide
  Seed: LIYRRRLMKQDFSVPQLPHSSSHWL (PMEL_HUMAN)
  Core: LMKQDFSVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRXMKXDXSVXQLPHSSSHWL

SEQ ID NO: 331199 - protein, 25 aa, Artificial Sequence
  Description of Artificial Sequence: Synthetic peptide
  Seed: LIYRRRLMKQDFSVPQLPHSSSHWL (PMEL_HUMAN)
  Core: MKQDFSVPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLXKQXFXVPXLPHSSSHWL

SEQ ID NO: 331200 - protein, 25 aa, Artificial Sequence
  Description of Artificial Sequence: Synthetic peptide
  Seed: LIYRRRLMKQDFSVPQLPHSSSHWL (PMEL_HUMAN)
  Core: FSVPQLPHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LIYRRRLMKQDXSVXQXPHXSSHWL

SEQ ID NO: 331201 - protein, 15 aa, Artificial Sequence
  Description of Artificial Sequence: Synthetic peptide
  Seed: LKGGSGTYCLNVSLA (PMEL_HUMAN)
  Core: GSGTYCLNV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LKGXSGXYXLNXSLA

SEQ ID NO: 331202 - protein, 16 aa, Artificial Sequence
  Description of Artificial Sequence: Synthetic peptide
  Seed: LKGGSGTYCLNVSLAD (PMEL_HUMAN)
  Core: SGTYCLNVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKGGXGTXCXNVXLAD

SEQ ID NO: 331203 - protein, 16 aa, Artificial Sequence
  Description of Artificial Sequence: Synthetic peptide
  Seed: LKGGSGTYCLNVSLAD (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAX

SEQ ID NO: 331204 - protein, 17 aa, Artificial Sequence
  Description of Artificial Sequence: Synthetic peptide
  Seed: LKGGSGTYCLNVSLADT (PMEL_HUMAN)
  Core: SGTYCLNVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKGGXGTXCXNVXLADT

SEQ ID NO: 331205 - protein, 17 aa, Artificial Sequence
  Description of Artificial Sequence: Synthetic peptide
  Seed: LKGGSGTYCLNVSLADT (PMEL_HUMAN)
  Core: TYCLNVSLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGXYCXNXSLXDT

SEQ ID NO: 331206 - protein, 17 aa, Artificial Sequence
  Description of Artificial Sequence: Synthetic peptide
  Seed: LKGGSGTYCLNVSLADT (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXT

SEQ ID NO: 331207 - protein, 19 aa, Artificial Sequence
  Description of Artificial Sequence: Synthetic peptide
  Seed: LKGGSGTYCLNVSLADTNS (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNS

SEQ ID NO: 331208 - protein, 20 aa, Artificial Sequence
  Description of Artificial Sequence: Synthetic peptide
  Seed: LKGGSGTYCLNVSLADTNSL (PMEL_HUMAN)
  Core: TYCLNVSLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGXYCXNXSLXDTNSL

SEQ ID NO: 331209 - protein, 20 aa, Artificial Sequence
  Description of Artificial Sequence: Synthetic peptide
  Seed: LKGGSGTYCLNVSLADTNSL (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNSL

SEQ ID NO: 331210 - protein, 21 aa, Artificial Sequence
  Description of Artificial Sequence: Synthetic peptide
  Seed: LKGGSGTYCLNVSLADTNSLA (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNSLA

SEQ ID NO: 331211 - protein, 22 aa, Artificial Sequence
  Description of Artificial Sequence: Synthetic peptide
  Seed: LKGGSGTYCLNVSLADTNSLAV (PMEL_HUMAN)
  Core: TYCLNVSLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGXYCXNXSLXDTNSLAV

SEQ ID NO: 331212 - protein, 22 aa, Artificial Sequence
  Description of Artificial Sequence: Synthetic peptide
  Seed: LKGGSGTYCLNVSLADTNSLAV (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNSLAV

SEQ ID NO: 331213 - protein, 22 aa, Artificial Sequence
  Description of Artificial Sequence: Synthetic peptide
  Seed: LKGGSGTYCLNVSLADTNSLAV (PMEL_HUMAN)
  Core: NVSLADTNS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTYCLXVSXAXTNXLAV

SEQ ID NO: 331214 - protein, 22 aa, Artificial Sequence
  Description of Artificial Sequence: Synthetic peptide
  Seed: LKGGSGTYCLNVSLADTNSLAV (PMEL_HUMAN)
  Core: VSLADTNSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTYCLNXSLXDXNSXAV

SEQ ID NO: 331215 - protein, 22 aa, Artificial Sequence
  Description of Artificial Sequence: Synthetic peptide
  Seed: LKGGSGTYCLNVSLADTNSLAV (PMEL_HUMAN)
  Core: LADTNSLAV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTYCLNVSXADXNXLAX

SEQ ID NO: 331216 - protein, 23 aa, Artificial Sequence
  Description of Artificial Sequence: Synthetic peptide
  Seed: LKGGSGTYCLNVSLADTNSLAVV (PMEL_HUMAN)
  Core: TYCLNVSLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGXYCXNXSLXDTNSLAVV

SEQ ID NO: 331217 - protein, 23 aa, Artificial Sequence
  Description of Artificial Sequence: Synthetic peptide
  Seed: LKGGSGTYCLNVSLADTNSLAVV (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNSLAVV

SEQ ID NO: 331218 - protein, 23 aa, Artificial Sequence
  Description of Artificial Sequence: Synthetic peptide
  Seed: LKGGSGTYCLNVSLADTNSLAVV (PMEL_HUMAN)
  Core: LADTNSLAV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTYCLNVSXADXNXLAXV

SEQ ID NO: 331219 - protein, 24 aa, Artificial Sequence
  Description of Artificial Sequence: Synthetic peptide
  Seed: LKGGSGTYCLNVSLADTNSLAVVS (PMEL_HUMAN)
  Core: TYCLNVSLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGXYCXNXSLXDTNSLAVVS

SEQ ID NO: 331220 - protein, 24 aa, Artificial Sequence
  Description of Artificial Sequence: Synthetic peptide
  Seed: LKGGSGTYCLNVSLADTNSLAVVS (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNSLAVVS

SEQ ID NO: 331221 - protein, 24 aa, Artificial Sequence
  Description of Artificial Sequence: Synthetic peptide
  Seed: LKGGSGTYCLNVSLADTNSLAVVS (PMEL_HUMAN)
  Core: LADTNSLAV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTYCLNVSXADXNXLAXVS

SEQ ID NO: 331222 - protein, 25 aa, Artificial Sequence
  Description of Artificial Sequence: Synthetic peptide
  Seed: LKGGSGTYCLNVSLADTNSLAVVST (PMEL_HUMAN)
  Core: TYCLNVSLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGXYCXNXSLXDTNSLAVVST

SEQ ID NO: 331223 - protein, 25 aa, Artificial Sequence
  Description of Artificial Sequence: Synthetic peptide
  Seed: LKGGSGTYCLNVSLADTNSLAVVST (PMEL_HUMAN)
  Core: YCLNVSLAD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTXCLXVXLAXTNSLAVVST

SEQ ID NO: 331224 - protein, 25 aa, Artificial Sequence
  Description of Artificial Sequence: Synthetic peptide
  Seed: LKGGSGTYCLNVSLADTNSLAVVST (PMEL_HUMAN)
  Core: LADTNSLAV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKGGSGTYCLNVSXADXNXLAXVST

SEQ ID NO: 331225 - protein, 13 aa, Artificial Sequence
  Description of Artificial Sequence: Synthetic peptide
  Seed: LKRCLLHLAVIGA (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGA

SEQ ID NO: 331226 - protein, 13 aa, Artificial Sequence
  Description of Artificial Sequence: Synthetic peptide
  Seed: LKRCLLHLAVIGA (PMEL_HUMAN)
  Core: CLLHLAVIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LKRXLLXLXVIXA

SEQ ID NO: 331227 - protein, 13 aa, Artificial Sequence
  Description of Artificial Sequence: Synthetic peptide
  Seed: LKRCLLHLAVIGA (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGX

SEQ ID NO: 331228 - protein, 14 aa, Artificial Sequence
  Description of Artificial Sequence: Synthetic peptide
  Seed: LKRCLLHLAVIGAL (PMEL_HUMAN)
  Core: KRCLLHLAV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRCXLXLAXIGAL

SEQ ID NO: 331229 - protein, 14 aa, Artificial Sequence
  Description of Artificial Sequence: Synthetic peptide
  Seed: LKRCLLHLAVIGAL (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGAL

SEQ ID NO: 331230 - protein, 14 aa, Artificial Sequence
  Description of Artificial Sequence: Synthetic peptide
  Seed: LKRCLLHLAVIGAL (PMEL_HUMAN)
  Core: CLLHLAVIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LKRXLLXLXVIXAL

SEQ ID NO: 331231 - protein, 14 aa, Artificial Sequence
  Description of Artificial Sequence: Synthetic peptide
  Seed: LKRCLLHLAVIGAL (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXL

SEQ ID NO: 331232 - protein, 14 aa, Artificial Sequence
  Description of Artificial Sequence: Synthetic peptide
  Seed: LKRCLLHLAVIGAL (PMEL_HUMAN)
  Core: LHLAVIGAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLXHLXVXGAX

SEQ ID NO: 331233 - protein, 15 aa, Artificial Sequence
  Description of Artificial Sequence: Synthetic peptide
  Seed: LKRCLLHLAVIGALL (PMEL_HUMAN)
  Core: KRCLLHLAV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRCXLXLAXIGALL

SEQ ID NO: 331234 - protein, 15 aa, Artificial Sequence
  Description of Artificial Sequence: Synthetic peptide
  Seed: LKRCLLHLAVIGALL (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGALL

SEQ ID NO: 331235 - protein, 15 aa, Artificial Sequence
  Description of Artificial Sequence: Synthetic peptide
  Seed: LKRCLLHLAVIGALL (PMEL_HUMAN)
  Core: CLLHLAVIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LKRXLLXLXVIXALL

SEQ ID NO: 331236 - protein, 15 aa, Artificial Sequence
  Description of Artificial Sequence: Synthetic peptide
  Seed: LKRCLLHLAVIGALL (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXLL

SEQ ID NO: 331237 - protein, 15 aa, Artificial Sequence
  Description of Artificial Sequence: Synthetic peptide
  Seed: LKRCLLHLAVIGALL (PMEL_HUMAN)
  Core: LHLAVIGAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLXHLXVXGAXL

SEQ ID NO: 331238 - protein, 15 aa, Artificial Sequence
  Description of Artificial Sequence: Synthetic peptide
  Seed: LKRCLLHLAVIGALL (PMEL_HUMAN)
  Core: HLAVIGALL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLXLAXIXALX

SEQ ID NO: 331239 - protein, 16 aa, Artificial Sequence
  Description of Artificial Sequence: Synthetic peptide
  Seed: LKRCLLHLAVIGALLA (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGALLA

SEQ ID NO: 331240 - protein, 16 aa, Artificial Sequence
  Description of Artificial Sequence: Synthetic peptide
  Seed: LKRCLLHLAVIGALLA (PMEL_HUMAN)
  Core: CLLHLAVIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LKRXLLXLXVIXALLA

SEQ ID NO: 331241 - protein, 16 aa, Artificial Sequence
  Description of Artificial Sequence: Synthetic peptide
  Seed: LKRCLLHLAVIGALLA (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXLLA

SEQ ID NO: 331242 - protein, 16 aa, Artificial Sequence
  Description of Artificial Sequence: Synthetic peptide
  Seed: LKRCLLHLAVIGALLA (PMEL_HUMAN)
  Core: LHLAVIGAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLXHLXVXGAXLA

SEQ ID NO: 331243 - protein, 16 aa, Artificial Sequence
  Description of Artificial Sequence: Synthetic peptide
  Seed: LKRCLLHLAVIGALLA (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLX

SEQ ID NO: 331244 - protein, 17 aa, Artificial Sequence
  Description of Artificial Sequence: Synthetic peptide
  Seed: LKRCLLHLAVIGALLAV (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGALLAV

SEQ ID NO: 331245 - protein, 17 aa, Artificial Sequence
  Description of Artificial Sequence: Synthetic peptide
  Seed: LKRCLLHLAVIGALLAV (PMEL_HUMAN)
  Core: CLLHLAVIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LKRXLLXLXVIXALLAV

SEQ ID NO: 331246 - protein, 17 aa, Artificial Sequence
  Description of Artificial Sequence: Synthetic peptide
  Seed: LKRCLLHLAVIGALLAV (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXLLAV

SEQ ID NO: 331247 - protein, 17 aa, Artificial Sequence
  Description of Artificial Sequence: Synthetic peptide
  Seed: LKRCLLHLAVIGALLAV (PMEL_HUMAN)
  Core: LHLAVIGAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLXHLXVXGAXLAV

SEQ ID NO: 331248 - protein, 17 aa, Artificial Sequence
  Description of Artificial Sequence: Synthetic peptide
  Seed: LKRCLLHLAVIGALLAV (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLXV

SEQ ID NO: 331249 - protein, 18 aa, Artificial Sequence
  Description of Artificial Sequence: Synthetic peptide
  Seed: LKRCLLHLAVIGALLAVG (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXLLAVG

SEQ ID NO: 331250 - protein, 18 aa, Artificial Sequence
  Description of Artificial Sequence: Synthetic peptide
  Seed: LKRCLLHLAVIGALLAVG (PMEL_HUMAN)
  Core: LHLAVIGAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLXHLXVXGAXLAVG

SEQ ID NO: 331251 - protein, 18 aa, Artificial Sequence
  Description of Artificial Sequence: Synthetic peptide
  Seed: LKRCLLHLAVIGALLAVG (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLXVG

SEQ ID NO: 331252 - protein, 18 aa, Artificial Sequence
  Description of Artificial Sequence: Synthetic peptide
  Seed: LKRCLLHLAVIGALLAVG (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVX

SEQ ID NO: 331253 - protein, 19 aa, Artificial Sequence
  Description of Artificial Sequence: Synthetic peptide
  Seed: LKRCLLHLAVIGALLAVGA (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGALLAVGA

SEQ ID NO: 331254 - protein, 19 aa, Artificial Sequence
  Description of Artificial Sequence: Synthetic peptide
  Seed: LKRCLLHLAVIGALLAVGA (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXLLAVGA

SEQ ID NO: 331255 - protein, 19 aa, Artificial Sequence
  Description of Artificial Sequence: Synthetic peptide
  Seed: LKRCLLHLAVIGALLAVGA (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLXVGA

SEQ ID NO: 331256 - protein, 19 aa, Artificial Sequence
  Description of Artificial Sequence: Synthetic peptide
  Seed: LKRCLLHLAVIGALLAVGA (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXA

SEQ ID NO: 331257 - protein, 20 aa, Artificial Sequence
  Description of Artificial Sequence: Synthetic peptide
  Seed: LKRCLLHLAVIGALLAVGAT (PMEL_HUMAN)
  Core: RCLLHLAVI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXCLXHXAVXGALLAVGAT

SEQ ID NO: 331258 - protein, 20 aa, Artificial Sequence
  Description of Artificial Sequence: Synthetic peptide
  Seed: LKRCLLHLAVIGALLAVGAT (PMEL_HUMAN)
  Core: LLHLAVIGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LKRCXLHXAXIGXLLAVGAT

SEQ ID NO: 331259 - protein, 20 aa, Artificial Sequence
  Description of Artificial Sequence: Synthetic peptide
  Seed: LKRCLLHLAVIGALLAVGAT (PMEL_HUMAN)
  Core: LHLAVIGAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLXHLXVXGAXLAVGAT

SEQ ID NO: 331260 - protein, 20 aa, Artificial Sequence
  Description of Artificial Sequence: Synthetic peptide
  Seed: LKRCLLHLAVIGALLAVGAT (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLXVGAT

SEQ ID NO: 331261 - protein, 20 aa, Artificial Sequence
  Description of Artificial Sequence: Synthetic peptide
  Seed: LKRCLLHLAVIGALLAVGAT (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXAT

SEQ ID NO: 331262 - protein, 20 aa, Artificial Sequence
  Description of Artificial Sequence: Synthetic peptide
  Seed: LKRCLLHLAVIGALLAVGAT (PMEL_HUMAN)
  Core: IGALLAVGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVXGAXLXVGXT

SEQ ID NO: 331263 - protein, 21 aa, Artificial Sequence
  Description of Artificial Sequence: Synthetic peptide
  Seed: LKRCLLHLAVIGALLAVGATK (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXATK

SEQ ID NO: 331264 - protein, 21 aa, Artificial Sequence
  Description of Artificial Sequence: Synthetic peptide
  Seed: LKRCLLHLAVIGALLAVGATK (PMEL_HUMAN)
  Core: IGALLAVGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVXGAXLXVGXTK

SEQ ID NO: 331265 - protein, 22 aa, Artificial Sequence
  Description of Artificial Sequence: Synthetic peptide
  Seed: LKRCLLHLAVIGALLAVGATKV (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLXVGATKV

SEQ ID NO: 331266 - protein, 22 aa, Artificial Sequence
  Description of Artificial Sequence: Synthetic peptide
  Seed: LKRCLLHLAVIGALLAVGATKV (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXATKV

SEQ ID NO: 331267 - protein, 22 aa, Artificial Sequence
  Description of Artificial Sequence: Synthetic peptide
  Seed: LKRCLLHLAVIGALLAVGATKV (PMEL_HUMAN)
  Core: IGALLAVGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVXGAXLXVGXTKV

SEQ ID NO: 331268 - protein, 22 aa, Artificial Sequence
  Description of Artificial Sequence: Synthetic peptide
  Seed: LKRCLLHLAVIGALLAVGATKV (PMEL_HUMAN)
  Core: LLAVGATKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVIGAXLAXGXTKX

SEQ ID NO: 331269 - protein, 23 aa, Artificial Sequence
  Description of Artificial Sequence: Synthetic peptide
  Seed: LKRCLLHLAVIGALLAVGATKVP (PMEL_HUMAN)
  Core: LAVIGALLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHXAVXGXLLXVGATKVP

SEQ ID NO: 331270 - protein, 23 aa, Artificial Sequence
  Description of Artificial Sequence: Synthetic peptide
  Seed: LKRCLLHLAVIGALLAVGATKVP (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXATKVP

SEQ ID NO: 331271 - protein, 23 aa, Artificial Sequence
  Description of Artificial Sequence: Synthetic peptide
  Seed: LKRCLLHLAVIGALLAVGATKVP (PMEL_HUMAN)
  Core: IGALLAVGA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVXGAXLXVGXTKVP

SEQ ID NO: 331272 - protein, 23 aa, Artificial Sequence
  Description of Artificial Sequence: Synthetic peptide
  Seed: LKRCLLHLAVIGALLAVGATKVP (PMEL_HUMAN)
  Core: LLAVGATKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVIGAXLAXGXTKXP

SEQ ID NO: 331273 - protein, 24 aa, Artificial Sequence
  Description of Artificial Sequence: Synthetic peptide
  Seed: LKRCLLHLAVIGALLAVGATKVPR (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXATKVPR

SEQ ID NO: 331274 - protein, 24 aa, Artificial Sequence
  Description of Artificial Sequence: Synthetic peptide
  Seed: LKRCLLHLAVIGALLAVGATKVPR (PMEL_HUMAN)
  Core: LLAVGATKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVIGAXLAXGXTKXPR

SEQ ID NO: 331275 - protein, 25 aa, Artificial Sequence
  Description of Artificial Sequence: Synthetic peptide
  Seed: LKRCLLHLAVIGALLAVGATKVPRN (PMEL_HUMAN)
  Core: VIGALLAVG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAXIGXLXAVXATKVPRN

SEQ ID NO: 331276 - protein, 25 aa, Artificial Sequence
  Description of Artificial Sequence: Synthetic peptide
  Seed: LKRCLLHLAVIGALLAVGATKVPRN (PMEL_HUMAN)
  Core: LLAVGATKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKRCLLHLAVIGAXLAXGXTKXPRN

SEQ ID NO: 331277 - protein, 15 aa, Artificial Sequence
  Description of Artificial Sequence: Synthetic peptide
  Seed: LKVSNDGPTLIGANA (PMEL_HUMAN)
  Core: VSNDGPTLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LKXSNXGXTLXGANA

SEQ ID NO: 331278 - protein, 16 aa, Artificial Sequence
  Description of Artificial Sequence: Synthetic peptide
  Seed: LKVSNDGPTLIGANAS (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAX

SEQ ID NO: 331279 - protein, 17 aa, Artificial Sequence
  Description of Artificial Sequence: Synthetic peptide
  Seed: LKVSNDGPTLIGANASF (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXF

SEQ ID NO: 331280 - protein, 18 aa, Artificial Sequence
  Description of Artificial Sequence: Synthetic peptide
  Seed: LKVSNDGPTLIGANASFS (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFX

SEQ ID NO: 331281 - protein, 19 aa, Artificial Sequence
  Description of Artificial Sequence: Synthetic peptide
  Seed: LKVSNDGPTLIGANASFSI (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSI

SEQ ID NO: 331282 - protein, 19 aa, Artificial Sequence
  Description of Artificial Sequence: Synthetic peptide
  Seed: LKVSNDGPTLIGANASFSI (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXI

SEQ ID NO: 331283 - protein, 19 aa, Artificial Sequence
  Description of Artificial Sequence: Synthetic peptide
  Seed: LKVSNDGPTLIGANASFSI (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSX

SEQ ID NO: 331284 - protein, 20 aa, Artificial Sequence
  Description of Artificial Sequence: Synthetic peptide
  Seed: LKVSNDGPTLIGANASFSIA (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSIA

SEQ ID NO: 331285 - protein, 20 aa, Artificial Sequence
  Description of Artificial Sequence: Synthetic peptide
  Seed: LKVSNDGPTLIGANASFSIA (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXIA

SEQ ID NO: 331286 - protein, 20 aa, Artificial Sequence
  Description of Artificial Sequence: Synthetic peptide
  Seed: LKVSNDGPTLIGANASFSIA (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSXA

SEQ ID NO: 331287 - protein, 21 aa, Artificial Sequence
  Description of Artificial Sequence: Synthetic peptide
  Seed: LKVSNDGPTLIGANASFSIAL (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSIAL

SEQ ID NO: 331288 - protein, 21 aa, Artificial Sequence
  Description of Artificial Sequence: Synthetic peptide
  Seed: LKVSNDGPTLIGANASFSIAL (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXIAL

SEQ ID NO: 331289 - protein, 21 aa, Artificial Sequence
  Description of Artificial Sequence: Synthetic peptide
  Seed: LKVSNDGPTLIGANASFSIAL (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSXAL

SEQ ID NO: 331290 - protein, 22 aa, Artificial Sequence
  Description of Artificial Sequence: Synthetic peptide
  Seed: LKVSNDGPTLIGANASFSIALN (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSIALN

SEQ ID NO: 331291 - protein, 22 aa, Artificial Sequence
  Description of Artificial Sequence: Synthetic peptide
  Seed: LKVSNDGPTLIGANASFSIALN (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXIALN

SEQ ID NO: 331292 - protein, 22 aa, Artificial Sequence
  Description of Artificial Sequence: Synthetic peptide
  Seed: LKVSNDGPTLIGANASFSIALN (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSXALN

SEQ ID NO: 331293 - protein, 23 aa, Artificial Sequence
  Description of Artificial Sequence: Synthetic peptide
  Seed: LKVSNDGPTLIGANASFSIALNF (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSIALNF

SEQ ID NO: 331294 - protein, 23 aa, Artificial Sequence
  Description of Artificial Sequence: Synthetic peptide
  Seed: LKVSNDGPTLIGANASFSIALNF (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXIALNF

SEQ ID NO: 331295 - protein, 23 aa, Artificial Sequence
  Description of Artificial Sequence: Synthetic peptide
  Seed: LKVSNDGPTLIGANASFSIALNF (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSXALNF

SEQ ID NO: 331296 - protein, 24 aa, Artificial Sequence
  Description of Artificial Sequence: Synthetic peptide
  Seed: LKVSNDGPTLIGANASFSIALNFP (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSIALNFP

SEQ ID NO: 331297 - protein, 24 aa, Artificial Sequence
  Description of Artificial Sequence: Synthetic peptide
  Seed: LKVSNDGPTLIGANASFSIALNFP (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXIALNFP

SEQ ID NO: 331298 - protein, 24 aa, Artificial Sequence
  Description of Artificial Sequence: Synthetic peptide
  Seed: LKVSNDGPTLIGANASFSIALNFP (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSXALNFP

SEQ ID NO: 331299 - protein, 24 aa, Artificial Sequence
  Description of Artificial Sequence: Synthetic peptide
  Seed: LKVSNDGPTLIGANASFSIALNFP (PMEL_HUMAN)
  Core: NASFSIALN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLIGAXASXSXALXFP

SEQ ID NO: 331300 - protein, 25 aa, Artificial Sequence
  Description of Artificial Sequence: Synthetic peptide
  Seed: LKVSNDGPTLIGANASFSIALNFPG (PMEL_HUMAN)
  Core: PTLIGANAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGXTLXGXNAXFSIALNFPG

SEQ ID NO: 331301 - protein, 25 aa, Artificial Sequence
  Description of Artificial Sequence: Synthetic peptide
  Seed: LKVSNDGPTLIGANASFSIALNFPG (PMEL_HUMAN)
  Core: LIGANASFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTXIGXNXSFXIALNFPG

SEQ ID NO: 331302 - protein, 25 aa, Artificial Sequence
  Description of Artificial Sequence: Synthetic peptide
  Seed: LKVSNDGPTLIGANASFSIALNFPG (PMEL_HUMAN)
  Core: IGANASFSI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLXGAXAXFSXALNFPG

SEQ ID NO: 331303 - protein, 25 aa, Artificial Sequence
  Description of Artificial Sequence: Synthetic peptide
  Seed: LKVSNDGPTLIGANASFSIALNFPG (PMEL_HUMAN)
  Core: NASFSIALN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLIGAXASXSXALXFPG

SEQ ID NO: 331304 - protein, 25 aa, Artificial Sequence
  Description of Artificial Sequence: Synthetic peptide
  Seed: LKVSNDGPTLIGANASFSIALNFPG (PMEL_HUMAN)
  Core: FSIALNFPG
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LKVSNDGPTLIGANASXSIXLXFPX

SEQ ID NO: 331305 - protein, 14 aa, Artificial Sequence
  Description of Artificial Sequence: Synthetic peptide
  Seed: LLAVGATKVPRNQD (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQD

SEQ ID NO: 331306 - protein, 15 aa, Artificial Sequence
  Description of Artificial Sequence: Synthetic peptide
  Seed: LLAVGATKVPRNQDW (PMEL_HUMAN)
  Core: AVGATKVPR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXVGXTXVPXNQDW

SEQ ID NO: 331307 - protein, 15 aa, Artificial Sequence
  Description of Artificial Sequence: Synthetic peptide
  Seed: LLAVGATKVPRNQDW (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDW

SEQ ID NO: 331308 - protein, 16 aa, Artificial Sequence
  Description of Artificial Sequence: Synthetic peptide
  Seed: LLAVGATKVPRNQDWL (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWL

SEQ ID NO: 331309 - protein, 17 aa, Artificial Sequence
  Description of Artificial Sequence: Synthetic peptide
  Seed: LLAVGATKVPRNQDWLG (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLG

SEQ ID NO: 331310 - protein, 19 aa, Artificial Sequence
  Description of Artificial Sequence: Synthetic peptide
  Seed: LLAVGATKVPRNQDWLGVS (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLGVS

SEQ ID NO: 331311 - protein, 20 aa, Artificial Sequence
  Description of Artificial Sequence: Synthetic peptide
  Seed: LLAVGATKVPRNQDWLGVSR (PMEL_HUMAN)
  Core: LLAVGATKV
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XLAXGXTKXPRNQDWLGVSR

SEQ ID NO: 331312 - protein, 20 aa, Artificial Sequence
  Description of Artificial Sequence: Synthetic peptide
  Seed: LLAVGATKVPRNQDWLGVSR (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLGVSR

SEQ ID NO: 331313 - protein, 22 aa, Artificial Sequence
  Description of Artificial Sequence: Synthetic peptide
  Seed: LLAVGATKVPRNQDWLGVSRQL (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLGVSRQL

SEQ ID NO: 331314 - protein, 22 aa, Artificial Sequence
  Description of Artificial Sequence: Synthetic peptide
  Seed: LLAVGATKVPRNQDWLGVSRQL (PMEL_HUMAN)
  Core: RNQDWLGVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPXNQXWXGVXRQL

SEQ ID NO: 331315 - protein, 23 aa, Artificial Sequence
  Description of Artificial Sequence: Synthetic peptide
  Seed: LLAVGATKVPRNQDWLGVSRQLR (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLGVSRQLR

SEQ ID NO: 331316 - protein, 23 aa, Artificial Sequence
  Description of Artificial Sequence: Synthetic peptide
  Seed: LLAVGATKVPRNQDWLGVSRQLR (PMEL_HUMAN)
  Core: RNQDWLGVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPXNQXWXGVXRQLR

SEQ ID NO: 331317 - protein, 23 aa, Artificial Sequence
  Description of Artificial Sequence: Synthetic peptide
  Seed: LLAVGATKVPRNQDWLGVSRQLR (PMEL_HUMAN)
  Core: WLGVSRQLR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPRNQDXLGXSXQLX

SEQ ID NO: 331318 - protein, 24 aa, Artificial Sequence
  Description of Artificial Sequence: Synthetic peptide
  Seed: LLAVGATKVPRNQDWLGVSRQLRT (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLGVSRQLRT

SEQ ID NO: 331319 - protein, 24 aa, Artificial Sequence
  Description of Artificial Sequence: Synthetic peptide
  Seed: LLAVGATKVPRNQDWLGVSRQLRT (PMEL_HUMAN)
  Core: RNQDWLGVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPXNQXWXGVXRQLRT

SEQ ID NO: 331320 - protein, 24 aa, Artificial Sequence
  Description of Artificial Sequence: Synthetic peptide
  Seed: LLAVGATKVPRNQDWLGVSRQLRT (PMEL_HUMAN)
  Core: WLGVSRQLR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPRNQDXLGXSXQLXT

SEQ ID NO: 331321 - protein, 25 aa, Artificial Sequence
  Description of Artificial Sequence: Synthetic peptide
  Seed: LLAVGATKVPRNQDWLGVSRQLRTK (PMEL_HUMAN)
  Core: VGATKVPRN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLAXGAXKXPRXQDWLGVSRQLRTK

SEQ ID NO: 331322 - protein, 25 aa, Artificial Sequence
  Description of Artificial Sequence: Synthetic peptide
  Seed: LLAVGATKVPRNQDWLGVSRQLRTK (PMEL_HUMAN)
  Core: PRNQDWLGV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVXRNXDXLGXSRQLRTK

SEQ ID NO: 331323 - protein, 25 aa, Artificial Sequence
  Description of Artificial Sequence: Synthetic peptide
  Seed: LLAVGATKVPRNQDWLGVSRQLRTK (PMEL_HUMAN)
  Core: RNQDWLGVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPXNQXWXGVXRQLRTK

SEQ ID NO: 331324 - protein, 25 aa, Artificial Sequence
  Description of Artificial Sequence: Synthetic peptide
  Seed: LLAVGATKVPRNQDWLGVSRQLRTK (PMEL_HUMAN)
  Core: WLGVSRQLR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LLAVGATKVPRNQDXLGXSXQLXTK

SEQ ID NO: 331325 - protein, 14 aa, Artificial Sequence
  Description of Artificial Sequence: Synthetic peptide
  Seed: LLDGTATLRLVKRQ (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQ

SEQ ID NO: 331326 - protein, 14 aa, Artificial Sequence
  Description of Artificial Sequence: Synthetic peptide
  Seed: LLDGTATLRLVKRQ (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQ

SEQ ID NO: 331327 - protein, 14 aa, Artificial Sequence
  Description of Artificial Sequence: Synthetic peptide
  Seed: LLDGTATLRLVKRQ (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQ

SEQ ID NO: 331328 - protein, 15 aa, Artificial Sequence
  Description of Artificial Sequence: Synthetic peptide
  Seed: LLDGTATLRLVKRQV (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQV

SEQ ID NO: 331329 - protein, 15 aa, Artificial Sequence
  Description of Artificial Sequence: Synthetic peptide
  Seed: LLDGTATLRLVKRQV (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQV

SEQ ID NO: 331330 - protein, 15 aa, Artificial Sequence
  Description of Artificial Sequence: Synthetic peptide
  Seed: LLDGTATLRLVKRQV (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQV

SEQ ID NO: 331331 - protein, 15 aa, Artificial Sequence
  Description of Artificial Sequence: Synthetic peptide
  Seed: LLDGTATLRLVKRQV (PMEL_HUMAN)
  Core: ATLRLVKRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTXTLXLXKRXV

SEQ ID NO: 331332 - protein, 15 aa, Artificial Sequence
  Description of Artificial Sequence: Synthetic peptide
  Seed: LLDGTATLRLVKRQV (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQX

SEQ ID NO: 331333 - protein, 16 aa, Artificial Sequence
  Description of Artificial Sequence: Synthetic peptide
  Seed: LLDGTATLRLVKRQVP (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVP

SEQ ID NO: 331334 - protein, 16 aa, Artificial Sequence
  Description of Artificial Sequence: Synthetic peptide
  Seed: LLDGTATLRLVKRQVP (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQVP

SEQ ID NO: 331335 - protein, 16 aa, Artificial Sequence
  Description of Artificial Sequence: Synthetic peptide
  Seed: LLDGTATLRLVKRQVP (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVP

SEQ ID NO: 331336 - protein, 16 aa, Artificial Sequence
  Description of Artificial Sequence: Synthetic peptide
  Seed: LLDGTATLRLVKRQVP (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVX

SEQ ID NO: 331337 - protein, 17 aa, Artificial Sequence
  Description of Artificial Sequence: Synthetic peptide
  Seed: LLDGTATLRLVKRQVPL (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPL

SEQ ID NO: 331338 - protein, 17 aa, Artificial Sequence
  Description of Artificial Sequence: Synthetic peptide
  Seed: LLDGTATLRLVKRQVPL (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQVPL

SEQ ID NO: 331339 - protein, 17 aa, Artificial Sequence
  Description of Artificial Sequence: Synthetic peptide
  Seed: LLDGTATLRLVKRQVPL (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPL

SEQ ID NO: 331340 - protein, 17 aa, Artificial Sequence
  Description of Artificial Sequence: Synthetic peptide
  Seed: LLDGTATLRLVKRQVPL (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQXPL

SEQ ID NO: 331341 - protein, 17 aa, Artificial Sequence
  Description of Artificial Sequence: Synthetic peptide
  Seed: LLDGTATLRLVKRQVPL (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXL

SEQ ID NO: 331342 - protein, 18 aa, Artificial Sequence
  Description of Artificial Sequence: Synthetic peptide
  Seed: LLDGTATLRLVKRQVPLD (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLD

SEQ ID NO: 331343 - protein, 19 aa, Artificial Sequence
  Description of Artificial Sequence: Synthetic peptide
  Seed: LLDGTATLRLVKRQVPLDC (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDC

SEQ ID NO: 331344 - protein, 19 aa, Artificial Sequence
  Description of Artificial Sequence: Synthetic peptide
  Seed: LLDGTATLRLVKRQVPLDC (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQVPLDC

SEQ ID NO: 331345 - protein, 19 aa, Artificial Sequence
  Description of Artificial Sequence: Synthetic peptide
  Seed: LLDGTATLRLVKRQVPLDC (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDC

SEQ ID NO: 331346 - protein, 19 aa, Artificial Sequence
  Description of Artificial Sequence: Synthetic peptide
  Seed: LLDGTATLRLVKRQVPLDC (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDC

SEQ ID NO: 331347 - protein, 20 aa, Artificial Sequence
  Description of Artificial Sequence: Synthetic peptide
  Seed: LLDGTATLRLVKRQVPLDCV (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDCV

SEQ ID NO: 331348 - protein, 20 aa, Artificial Sequence
  Description of Artificial Sequence: Synthetic peptide
  Seed: LLDGTATLRLVKRQVPLDCV (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQVPLDCV

SEQ ID NO: 331349 - protein, 20 aa, Artificial Sequence
  Description of Artificial Sequence: Synthetic peptide
  Seed: LLDGTATLRLVKRQVPLDCV (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDCV

SEQ ID NO: 331350 - protein, 20 aa, Artificial Sequence
  Description of Artificial Sequence: Synthetic peptide
  Seed: LLDGTATLRLVKRQVPLDCV (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQXPLDCV

SEQ ID NO: 331351 - protein, 20 aa, Artificial Sequence
  Description of Artificial Sequence: Synthetic peptide
  Seed: LLDGTATLRLVKRQVPLDCV (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDCV

SEQ ID NO: 331352 - protein, 20 aa, Artificial Sequence
  Description of Artificial Sequence: Synthetic peptide
  Seed: LLDGTATLRLVKRQVPLDCV (PMEL_HUMAN)
  Core: RLVKRQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLXLVXRXVPXDCV

SEQ ID NO: 331353 - protein, 20 aa, Artificial Sequence
  Description of Artificial Sequence: Synthetic peptide
  Seed: LLDGTATLRLVKRQVPLDCV (PMEL_HUMAN)
  Core: LVKRQVPLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRXVKXQXPLXCV

SEQ ID NO: 331354 - protein, 20 aa, Artificial Sequence
  Description of Artificial Sequence: Synthetic peptide
  Seed: LLDGTATLRLVKRQVPLDCV (PMEL_HUMAN)
  Core: VKRQVPLDC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLXKRXVXLDXV

SEQ ID NO: 331355 - protein, 21 aa, Artificial Sequence
  Description of Artificial Sequence: Synthetic peptide
  Seed: LLDGTATLRLVKRQVPLDCVL (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDCVL

SEQ ID NO: 331356 - protein, 21 aa, Artificial Sequence
  Description of Artificial Sequence: Synthetic peptide
  Seed: LLDGTATLRLVKRQVPLDCVL (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDCVL

SEQ ID NO: 331357 - protein, 21 aa, Artificial Sequence
  Description of Artificial Sequence: Synthetic peptide
  Seed: LLDGTATLRLVKRQVPLDCVL (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDCVL

SEQ ID NO: 331358 - protein, 21 aa, Artificial Sequence
  Description of Artificial Sequence: Synthetic peptide
  Seed: LLDGTATLRLVKRQVPLDCVL (PMEL_HUMAN)
  Core: RLVKRQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLXLVXRXVPXDCVL

SEQ ID NO: 331359 - protein, 21 aa, Artificial Sequence
  Description of Artificial Sequence: Synthetic peptide
  Seed: LLDGTATLRLVKRQVPLDCVL (PMEL_HUMAN)
  Core: LVKRQVPLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRXVKXQXPLXCVL

SEQ ID NO: 331360 - protein, 21 aa, Artificial Sequence
  Description of Artificial Sequence: Synthetic peptide
  Seed: LLDGTATLRLVKRQVPLDCVL (PMEL_HUMAN)
  Core: VKRQVPLDC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLXKRXVXLDXVL

SEQ ID NO: 331361 - protein, 22 aa, Artificial Sequence
  Description of Artificial Sequence: Synthetic peptide
  Seed: LLDGTATLRLVKRQVPLDCVLY (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDCVLY

SEQ ID NO: 331362 - protein, 22 aa, Artificial Sequence
  Description of Artificial Sequence: Synthetic peptide
  Seed: LLDGTATLRLVKRQVPLDCVLY (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDCVLY

SEQ ID NO: 331363 - protein, 22 aa, Artificial Sequence
  Description of Artificial Sequence: Synthetic peptide
  Seed: LLDGTATLRLVKRQVPLDCVLY (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQXPLDCVLY

SEQ ID NO: 331364 - protein, 22 aa, Artificial Sequence
  Description of Artificial Sequence: Synthetic peptide
  Seed: LLDGTATLRLVKRQVPLDCVLY (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDCVLY

SEQ ID NO: 331365 - protein, 22 aa, Artificial Sequence
  Description of Artificial Sequence: Synthetic peptide
  Seed: LLDGTATLRLVKRQVPLDCVLY (PMEL_HUMAN)
  Core: RLVKRQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLXLVXRXVPXDCVLY

SEQ ID NO: 331366 - protein, 22 aa, Artificial Sequence
  Description of Artificial Sequence: Synthetic peptide
  Seed: LLDGTATLRLVKRQVPLDCVLY (PMEL_HUMAN)
  Core: LVKRQVPLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRXVKXQXPLXCVLY

SEQ ID NO: 331367 - protein, 22 aa, Artificial Sequence
  Description of Artificial Sequence: Synthetic peptide
  Seed: LLDGTATLRLVKRQVPLDCVLY (PMEL_HUMAN)
  Core: VKRQVPLDC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLXKRXVXLDXVLY

SEQ ID NO: 331368 - protein, 22 aa, Artificial Sequence
  Description of Artificial Sequence: Synthetic peptide
  Seed: LLDGTATLRLVKRQVPLDCVLY (PMEL_HUMAN)
  Core: KRQVPLDCV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVXRQXPXDCXLY

SEQ ID NO: 331369 - protein, 23 aa, Artificial Sequence
  Description of Artificial Sequence: Synthetic peptide
  Seed: LLDGTATLRLVKRQVPLDCVLYR (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDCVLYR

SEQ ID NO: 331370 - protein, 23 aa, Artificial Sequence
  Description of Artificial Sequence: Synthetic peptide
  Seed: LLDGTATLRLVKRQVPLDCVLYR (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDCVLYR

SEQ ID NO: 331371 - protein, 23 aa, Artificial Sequence
  Description of Artificial Sequence: Synthetic peptide
  Seed: LLDGTATLRLVKRQVPLDCVLYR (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQXPLDCVLYR

SEQ ID NO: 331372 - protein, 23 aa, Artificial Sequence
  Description of Artificial Sequence: Synthetic peptide
  Seed: LLDGTATLRLVKRQVPLDCVLYR (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDCVLYR

SEQ ID NO: 331373 - protein, 23 aa, Artificial Sequence
  Description of Artificial Sequence: Synthetic peptide
  Seed: LLDGTATLRLVKRQVPLDCVLYR (PMEL_HUMAN)
  Core: RLVKRQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLXLVXRXVPXDCVLYR

SEQ ID NO: 331374 - protein, 23 aa, Artificial Sequence
  Description of Artificial Sequence: Synthetic peptide
  Seed: LLDGTATLRLVKRQVPLDCVLYR (PMEL_HUMAN)
  Core: LVKRQVPLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRXVKXQXPLXCVLYR

SEQ ID NO: 331375 - protein, 23 aa, Artificial Sequence
  Description of Artificial Sequence: Synthetic peptide
  Seed: LLDGTATLRLVKRQVPLDCVLYR (PMEL_HUMAN)
  Core: VKRQVPLDC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLXKRXVXLDXVLYR

SEQ ID NO: 331376 - protein, 23 aa, Artificial Sequence
  Description of Artificial Sequence: Synthetic peptide
  Seed: LLDGTATLRLVKRQVPLDCVLYR (PMEL_HUMAN)
  Core: KRQVPLDCV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVXRQXPXDCXLYR

SEQ ID NO: 331377 - protein, 24 aa, Artificial Sequence
  Description of Artificial Sequence: Synthetic peptide
  Seed: LLDGTATLRLVKRQVPLDCVLYRY (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDCVLYRY

SEQ ID NO: 331378 - protein, 24 aa, Artificial Sequence
  Description of Artificial Sequence: Synthetic peptide
  Seed: LLDGTATLRLVKRQVPLDCVLYRY (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDCVLYRY

SEQ ID NO: 331379 - protein, 24 aa, Artificial Sequence
  Description of Artificial Sequence: Synthetic peptide
  Seed: LLDGTATLRLVKRQVPLDCVLYRY (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQXPLDCVLYRY

SEQ ID NO: 331380 - protein, 24 aa, Artificial Sequence
  Description of Artificial Sequence: Synthetic peptide
  Seed: LLDGTATLRLVKRQVPLDCVLYRY (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDCVLYRY

SEQ ID NO: 331381 - protein, 24 aa, Artificial Sequence
  Description of Artificial Sequence: Synthetic peptide
  Seed: LLDGTATLRLVKRQVPLDCVLYRY (PMEL_HUMAN)
  Core: RLVKRQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLXLVXRXVPXDCVLYRY

SEQ ID NO: 331382 - protein, 24 aa, Artificial Sequence
  Description of Artificial Sequence: Synthetic peptide
  Seed: LLDGTATLRLVKRQVPLDCVLYRY (PMEL_HUMAN)
  Core: LVKRQVPLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRXVKXQXPLXCVLYRY

SEQ ID NO: 331383 - protein, 24 aa, Artificial Sequence
  Description of Artificial Sequence: Synthetic peptide
  Seed: LLDGTATLRLVKRQVPLDCVLYRY (PMEL_HUMAN)
  Core: VKRQVPLDC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLXKRXVXLDXVLYRY

SEQ ID NO: 331384 - protein, 24 aa, Artificial Sequence
  Description of Artificial Sequence: Synthetic peptide
  Seed: LLDGTATLRLVKRQVPLDCVLYRY (PMEL_HUMAN)
  Core: KRQVPLDCV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVXRQXPXDCXLYRY

SEQ ID NO: 331385 - protein, 24 aa, Artificial Sequence
  Description of Artificial Sequence: Synthetic peptide
  Seed: LLDGTATLRLVKRQVPLDCVLYRY (PMEL_HUMAN)
  Core: QVPLDCVLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVKRXVPXDXVLXRY

SEQ ID NO: 331386 - protein, 24 aa, Artificial Sequence
  Description of Artificial Sequence: Synthetic peptide
  Seed: LLDGTATLRLVKRQVPLDCVLYRY (PMEL_HUMAN)
  Core: VPLDCVLYR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVKRQXPLXCXLYXY

SEQ ID NO: 331387 - protein, 25 aa, Artificial Sequence
  Description of Artificial Sequence: Synthetic peptide
  Seed: LLDGTATLRLVKRQVPLDCVLYRYG (PMEL_HUMAN)
  Core: LDGTATLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXDGXAXLRXVKRQVPLDCVLYRYG

SEQ ID NO: 331388 - protein, 25 aa, Artificial Sequence
  Description of Artificial Sequence: Synthetic peptide
  Seed: LLDGTATLRLVKRQVPLDCVLYRYG (PMEL_HUMAN)
  Core: DGTATLRLV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXGTXTXRLXKRQVPLDCVLYRYG

SEQ ID NO: 331389 - protein, 25 aa, Artificial Sequence
  Description of Artificial Sequence: Synthetic peptide
  Seed: LLDGTATLRLVKRQVPLDCVLYRYG (PMEL_HUMAN)
  Core: TATLRLVKR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLDGXATXRXVKXQVPLDCVLYRYG

SEQ ID NO: 331390 - protein, 25 aa, Artificial Sequence
  Description of Artificial Sequence: Synthetic peptide
  Seed: LLDGTATLRLVKRQVPLDCVLYRYG (PMEL_HUMAN)
  Core: TLRLVKRQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTAXLRXVXRQXPLDCVLYRYG

SEQ ID NO: 331391 - protein, 25 aa, Artificial Sequence
  Description of Artificial Sequence: Synthetic peptide
  Seed: LLDGTATLRLVKRQVPLDCVLYRYG (PMEL_HUMAN)
  Core: LRLVKRQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATXRLXKXQVXLDCVLYRYG

SEQ ID NO: 331392 - protein, 25 aa, Artificial Sequence
  Description of Artificial Sequence: Synthetic peptide
  Seed: LLDGTATLRLVKRQVPLDCVLYRYG (PMEL_HUMAN)
  Core: RLVKRQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLXLVXRXVPXDCVLYRYG

SEQ ID NO: 331393 - protein, 25 aa, Artificial Sequence
  Description of Artificial Sequence: Synthetic peptide
  Seed: LLDGTATLRLVKRQVPLDCVLYRYG (PMEL_HUMAN)
  Core: LVKRQVPLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRXVKXQXPLXCVLYRYG

SEQ ID NO: 331394 - protein, 25 aa, Artificial Sequence
  Description of Artificial Sequence: Synthetic peptide
  Seed: LLDGTATLRLVKRQVPLDCVLYRYG (PMEL_HUMAN)
  Core: VKRQVPLDC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLXKRXVXLDXVLYRYG

SEQ ID NO: 331395 - protein, 25 aa, Artificial Sequence
  Description of Artificial Sequence: Synthetic peptide
  Seed: LLDGTATLRLVKRQVPLDCVLYRYG (PMEL_HUMAN)
  Core: KRQVPLDCV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVXRQXPXDCXLYRYG

SEQ ID NO: 331396 - protein, 25 aa, Artificial Sequence
  Description of Artificial Sequence: Synthetic peptide
  Seed: LLDGTATLRLVKRQVPLDCVLYRYG (PMEL_HUMAN)
  Core: QVPLDCVLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVKRXVPXDXVLXRYG

SEQ ID NO: 331397 - protein, 25 aa, Artificial Sequence
  Description of Artificial Sequence: Synthetic peptide
  Seed: LLDGTATLRLVKRQVPLDCVLYRYG (PMEL_HUMAN)
  Core: VPLDCVLYR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LLDGTATLRLVKRQXPLXCXLYXYG

SEQ ID NO: 331398 - protein, 13 aa, Artificial Sequence
  Description of Artificial Sequence: Synthetic peptide
  Seed: LLHLAVIGALLAV (PMEL_HUMAN)
  Core: LAVIGALLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLHXAVXGXLLXV

SEQ ID NO: 331399 - protein, 14 aa, Artificial Sequence
  Description of Artificial Sequence: Synthetic peptide
  Seed: LLHLAVIGALLAVG (PMEL_HUMAN)
  Core: LAVIGALLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLHXAVXGXLLXVG

SEQ ID NO: 331400 - protein, 14 aa, Artificial Sequence
  Description of Artificial Sequence: Synthetic peptide
  Seed: LLHLAVIGALLAVG (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVX

SEQ ID NO: 331401 - protein, 15 aa, Artificial Sequence
  Description of Artificial Sequence: Synthetic peptide
  Seed: LLHLAVIGALLAVGA (PMEL_HUMAN)
  Core: LAVIGALLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLHXAVXGXLLXVGA

SEQ ID NO: 331402 - protein, 15 aa, Artificial Sequence
  Description of Artificial Sequence: Synthetic peptide
  Seed: LLHLAVIGALLAVGA (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXA

SEQ ID NO: 331403 - protein, 16 aa, Artificial Sequence
  Description of Artificial Sequence: Synthetic peptide
  Seed: LLHLAVIGALLAVGAT (PMEL_HUMAN)
  Core: LAVIGALLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLHXAVXGXLLXVGAT

SEQ ID NO: 331404 - protein, 16 aa, Artificial Sequence
  Description of Artificial Sequence: Synthetic peptide
  Seed: LLHLAVIGALLAVGAT (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXAT

SEQ ID NO: 331405 - protein, 16 aa, Artificial Sequence
  Description of Artificial Sequence: Synthetic peptide
  Seed: LLHLAVIGALLAVGAT (PMEL_HUMAN)
  Core: IGALLAVGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVXGAXLXVGXT

SEQ ID NO: 331406 - protein, 17 aa, Artificial Sequence
  Description of Artificial Sequence: Synthetic peptide
  Seed: LLHLAVIGALLAVGATK (PMEL_HUMAN)
  Core: LAVIGALLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLHXAVXGXLLXVGATK

SEQ ID NO: 331407 - protein, 17 aa, Artificial Sequence
  Description of Artificial Sequence: Synthetic peptide
  Seed: LLHLAVIGALLAVGATK (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXATK

SEQ ID NO: 331408 - protein, 17 aa, Artificial Sequence
  Description of Artificial Sequence: Synthetic peptide
  Seed: LLHLAVIGALLAVGATK (PMEL_HUMAN)
  Core: IGALLAVGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVXGAXLXVGXTK

SEQ ID NO: 331409 - protein, 18 aa, Artificial Sequence
  Description of Artificial Sequence: Synthetic peptide
  Seed: LLHLAVIGALLAVGATKV (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXATKV

SEQ ID NO: 331410 - protein, 18 aa, Artificial Sequence
  Description of Artificial Sequence: Synthetic peptide
  Seed: LLHLAVIGALLAVGATKV (PMEL_HUMAN)
  Core: IGALLAVGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVXGAXLXVGXTKV

SEQ ID NO: 331411 - protein, 18 aa, Artificial Sequence
  Description of Artificial Sequence: Synthetic peptide
  Seed: LLHLAVIGALLAVGATKV (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKX

SEQ ID NO: 331412 - protein, 19 aa, Artificial Sequence
  Description of Artificial Sequence: Synthetic peptide
  Seed: LLHLAVIGALLAVGATKVP (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXATKVP

SEQ ID NO: 331413 - protein, 19 aa, Artificial Sequence
  Description of Artificial Sequence: Synthetic peptide
  Seed: LLHLAVIGALLAVGATKVP (PMEL_HUMAN)
  Core: IGALLAVGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVXGAXLXVGXTKVP

SEQ ID NO: 331414 - protein, 19 aa, Artificial Sequence
  Description of Artificial Sequence: Synthetic peptide
  Seed: LLHLAVIGALLAVGATKVP (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXP

SEQ ID NO: 331415 - protein, 20 aa, Artificial Sequence
  Description of Artificial Sequence: Synthetic peptide
  Seed: LLHLAVIGALLAVGATKVPR (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXATKVPR

SEQ ID NO: 331416 - protein, 20 aa, Artificial Sequence
  Description of Artificial Sequence: Synthetic peptide
  Seed: LLHLAVIGALLAVGATKVPR (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXPR

SEQ ID NO: 331417 - protein, 21 aa, Artificial Sequence
  Description of Artificial Sequence: Synthetic peptide
  Seed: LLHLAVIGALLAVGATKVPRN (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXATKVPRN

SEQ ID NO: 331418 - protein, 21 aa, Artificial Sequence
  Description of Artificial Sequence: Synthetic peptide
  Seed: LLHLAVIGALLAVGATKVPRN (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXPRN

SEQ ID NO: 331419 - protein, 22 aa, Artificial Sequence
  Description of Artificial Sequence: Synthetic peptide
  Seed: LLHLAVIGALLAVGATKVPRNQ (PMEL_HUMAN)
  Core: VIGALLAVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAXIGXLXAVXATKVPRNQ

SEQ ID NO: 331420 - protein, 22 aa, Artificial Sequence
  Description of Artificial Sequence: Synthetic peptide
  Seed: LLHLAVIGALLAVGATKVPRNQ (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXPRNQ

SEQ ID NO: 331421 - protein, 23 aa, Artificial Sequence
  Description of Artificial Sequence: Synthetic peptide
  Seed: LLHLAVIGALLAVGATKVPRNQD (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXPRNQD

SEQ ID NO: 331422 - protein, 23 aa, Artificial Sequence
  Description of Artificial Sequence: Synthetic peptide
  Seed: LLHLAVIGALLAVGATKVPRNQD (PMEL_HUMAN)
  Core: VGATKVPRN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGALLAXGAXKXPRXQD

SEQ ID NO: 331423 - protein, 24 aa, Artificial Sequence
  Description of Artificial Sequence: Synthetic peptide
  Seed: LLHLAVIGALLAVGATKVPRNQDW (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXPRNQDW

SEQ ID NO: 331424 - protein, 24 aa, Artificial Sequence
  Description of Artificial Sequence: Synthetic peptide
  Seed: LLHLAVIGALLAVGATKVPRNQDW (PMEL_HUMAN)
  Core: VGATKVPRN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGALLAXGAXKXPRXQDW

SEQ ID NO: 331425 - protein, 25 aa, Artificial Sequence
  Description of Artificial Sequence: Synthetic peptide
  Seed: LLHLAVIGALLAVGATKVPRNQDWL (PMEL_HUMAN)
  Core: LLAVGATKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGAXLAXGXTKXPRNQDWL

SEQ ID NO: 331426 - protein, 25 aa, Artificial Sequence
  Description of Artificial Sequence: Synthetic peptide
  Seed: LLHLAVIGALLAVGATKVPRNQDWL (PMEL_HUMAN)
  Core: VGATKVPRN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LLHLAVIGALLAXGAXKXPRXQDWL

SEQ ID NO: 331427 - protein, 13 aa, Artificial Sequence
  Description of Artificial Sequence: Synthetic peptide
  Seed: LLVLMAVVLASLI (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLI

SEQ ID NO: 331428 - protein, 14 aa, Artificial Sequence
  Description of Artificial Sequence: Synthetic peptide
  Seed: LLVLMAVVLASLIY (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIY

SEQ ID NO: 331429 - protein, 15 aa, Artificial Sequence
  Description of Artificial Sequence: Synthetic peptide
  Seed: LLVLMAVVLASLIYR (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYR

SEQ ID NO: 331430 - protein, 15 aa, Artificial Sequence
  Description of Artificial Sequence: Synthetic peptide
  Seed: LLVLMAVVLASLIYR (PMEL_HUMAN)
  Core: LMAVVLASL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLVXMAXVXASXIYR

SEQ ID NO: 331431 - protein, 15 aa, Artificial Sequence
  Description of Artificial Sequence: Synthetic peptide
  Seed: LLVLMAVVLASLIYR (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYR

SEQ ID NO: 331432 - protein, 15 aa, Artificial Sequence
  Description of Artificial Sequence: Synthetic peptide
  Seed: LLVLMAVVLASLIYR (PMEL_HUMAN)
  Core: VVLASLIYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAXVLXSXIYX

SEQ ID NO: 331433 - protein, 16 aa, Artificial Sequence
  Description of Artificial Sequence: Synthetic peptide
  Seed: LLVLMAVVLASLIYRR (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYRR

SEQ ID NO: 331434 - protein, 16 aa, Artificial Sequence
  Description of Artificial Sequence: Synthetic peptide
  Seed: LLVLMAVVLASLIYRR (PMEL_HUMAN)
  Core: LMAVVLASL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLVXMAXVXASXIYRR

SEQ ID NO: 331435 - protein, 16 aa, Artificial Sequence
  Description of Artificial Sequence: Synthetic peptide
  Seed: LLVLMAVVLASLIYRR (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRR

SEQ ID NO: 331436 - protein, 16 aa, Artificial Sequence
  Description of Artificial Sequence: Synthetic peptide
  Seed: LLVLMAVVLASLIYRR (PMEL_HUMAN)
  Core: VVLASLIYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAXVLXSXIYXR

SEQ ID NO: 331437 - protein, 16 aa, Artificial Sequence
  Description of Artificial Sequence: Synthetic peptide
  Seed: LLVLMAVVLASLIYRR (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRX

SEQ ID NO: 331438 - protein, 17 aa, Artificial Sequence
  Description of Artificial Sequence: Synthetic peptide
  Seed: LLVLMAVVLASLIYRRR (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYRRR

SEQ ID NO: 331439 - protein, 17 aa, Artificial Sequence
  Description of Artificial Sequence: Synthetic peptide
  Seed: LLVLMAVVLASLIYRRR (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRR

SEQ ID NO: 331440 - protein, 17 aa, Artificial Sequence
  Description of Artificial Sequence: Synthetic peptide
  Seed: LLVLMAVVLASLIYRRR (PMEL_HUMAN)
  Core: AVVLASLIY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMXVVXAXLIXRRR

SEQ ID NO: 331441 - protein, 17 aa, Artificial Sequence
  Description of Artificial Sequence: Synthetic peptide
  Seed: LLVLMAVVLASLIYRRR (PMEL_HUMAN)
  Core: VVLASLIYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAXVLXSXIYXRR

SEQ ID NO: 331442 - protein, 17 aa, Artificial Sequence
  Description of Artificial Sequence: Synthetic peptide
  Seed: LLVLMAVVLASLIYRRR (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXR

SEQ ID NO: 331443 - protein, 17 aa, Artificial Sequence
  Description of Artificial Sequence: Synthetic peptide
  Seed: LLVLMAVVLASLIYRRR (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRX

SEQ ID NO: 331444 - protein, 18 aa, Artificial Sequence
  Description of Artificial Sequence: Synthetic peptide
  Seed: LLVLMAVVLASLIYRRRL (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYRRRL

SEQ ID NO: 331445 - protein, 18 aa, Artificial Sequence
  Description of Artificial Sequence: Synthetic peptide
  Seed: LLVLMAVVLASLIYRRRL (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRL

SEQ ID NO: 331446 - protein, 18 aa, Artificial Sequence
  Description of Artificial Sequence: Synthetic peptide
  Seed: LLVLMAVVLASLIYRRRL (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRL

SEQ ID NO: 331447 - protein, 18 aa, Artificial Sequence
  Description of Artificial Sequence: Synthetic peptide
  Seed: LLVLMAVVLASLIYRRRL (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXL

SEQ ID NO: 331448 - protein, 19 aa, Artificial Sequence
  Description of Artificial Sequence: Synthetic peptide
  Seed: LLVLMAVVLASLIYRRRLM (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYRRRLM

SEQ ID NO: 331449 - protein, 19 aa, Artificial Sequence
  Description of Artificial Sequence: Synthetic peptide
  Seed: LLVLMAVVLASLIYRRRLM (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLM

SEQ ID NO: 331450 - protein, 19 aa, Artificial Sequence
  Description of Artificial Sequence: Synthetic peptide
  Seed: LLVLMAVVLASLIYRRRLM (PMEL_HUMAN)
  Core: AVVLASLIY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMXVVXAXLIXRRRLM

SEQ ID NO: 331451 - protein, 19 aa, Artificial Sequence
  Description of Artificial Sequence: Synthetic peptide
  Seed: LLVLMAVVLASLIYRRRLM (PMEL_HUMAN)
  Core: VVLASLIYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAXVLXSXIYXRRLM

SEQ ID NO: 331452 - protein, 19 aa, Artificial Sequence
  Description of Artificial Sequence: Synthetic peptide
  Seed: LLVLMAVVLASLIYRRRLM (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLM

SEQ ID NO: 331453 - protein, 19 aa, Artificial Sequence
  Description of Artificial Sequence: Synthetic peptide
  Seed: LLVLMAVVLASLIYRRRLM (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLM

SEQ ID NO: 331454 - protein, 20 aa, Artificial Sequence
  Description of Artificial Sequence: Synthetic peptide
  Seed: LLVLMAVVLASLIYRRRLMK (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYRRRLMK

SEQ ID NO: 331455 - protein, 20 aa, Artificial Sequence
  Description of Artificial Sequence: Synthetic peptide
  Seed: LLVLMAVVLASLIYRRRLMK (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLMK

SEQ ID NO: 331456 - protein, 20 aa, Artificial Sequence
  Description of Artificial Sequence: Synthetic peptide
  Seed: LLVLMAVVLASLIYRRRLMK (PMEL_HUMAN)
  Core: AVVLASLIY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMXVVXAXLIXRRRLMK

SEQ ID NO: 331457 - protein, 20 aa, Artificial Sequence
  Description of Artificial Sequence: Synthetic peptide
  Seed: LLVLMAVVLASLIYRRRLMK (PMEL_HUMAN)
  Core: VVLASLIYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAXVLXSXIYXRRLMK

SEQ ID NO: 331458 - protein, 20 aa, Artificial Sequence
  Description of Artificial Sequence: Synthetic peptide
  Seed: LLVLMAVVLASLIYRRRLMK (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLMK

SEQ ID NO: 331459 - protein, 20 aa, Artificial Sequence
  Description of Artificial Sequence: Synthetic peptide
  Seed: LLVLMAVVLASLIYRRRLMK (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLMK

SEQ ID NO: 331460 - protein, 21 aa, Artificial Sequence
  Description of Artificial Sequence: Synthetic peptide
  Seed: LLVLMAVVLASLIYRRRLMKQ (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLMKQ

SEQ ID NO: 331461 - protein, 21 aa, Artificial Sequence
  Description of Artificial Sequence: Synthetic peptide
  Seed: LLVLMAVVLASLIYRRRLMKQ (PMEL_HUMAN)
  Core: VVLASLIYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAXVLXSXIYXRRLMKQ

SEQ ID NO: 331462 - protein, 21 aa, Artificial Sequence
  Description of Artificial Sequence: Synthetic peptide
  Seed: LLVLMAVVLASLIYRRRLMKQ (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLMKQ

SEQ ID NO: 331463 - protein, 21 aa, Artificial Sequence
  Description of Artificial Sequence: Synthetic peptide
  Seed: LLVLMAVVLASLIYRRRLMKQ (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLMKQ

SEQ ID NO: 331464 - protein, 21 aa, Artificial Sequence
  Description of Artificial Sequence: Synthetic peptide
  Seed: LLVLMAVVLASLIYRRRLMKQ (PMEL_HUMAN)
  Core: ASLIYRRRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLXSLXYXRRXMKQ

SEQ ID NO: 331465 - protein, 21 aa, Artificial Sequence
  Description of Artificial Sequence: Synthetic peptide
  Seed: LLVLMAVVLASLIYRRRLMKQ (PMEL_HUMAN)
  Core: SLIYRRRLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLAXLIXRXRLXKQ

SEQ ID NO: 331466 - protein, 21 aa, Artificial Sequence
  Description of Artificial Sequence: Synthetic peptide
  Seed: LLVLMAVVLASLIYRRRLMKQ (PMEL_HUMAN)
  Core: LIYRRRLMK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASXIYXRXLMXQ

SEQ ID NO: 331467 - protein, 22 aa, Artificial Sequence
  Description of Artificial Sequence: Synthetic peptide
  Seed: LLVLMAVVLASLIYRRRLMKQD (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLMKQD

SEQ ID NO: 331468 - protein, 22 aa, Artificial Sequence
  Description of Artificial Sequence: Synthetic peptide
  Seed: LLVLMAVVLASLIYRRRLMKQD (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLMKQD

SEQ ID NO: 331469 - protein, 22 aa, Artificial Sequence
  Description of Artificial Sequence: Synthetic peptide
  Seed: LLVLMAVVLASLIYRRRLMKQD (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLMKQD

SEQ ID NO: 331470 - protein, 22 aa, Artificial Sequence
  Description of Artificial Sequence: Synthetic peptide
  Seed: LLVLMAVVLASLIYRRRLMKQD (PMEL_HUMAN)
  Core: ASLIYRRRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLXSLXYXRRXMKQD

SEQ ID NO: 331471 - protein, 22 aa, Artificial Sequence
  Description of Artificial Sequence: Synthetic peptide
  Seed: LLVLMAVVLASLIYRRRLMKQD (PMEL_HUMAN)
  Core: SLIYRRRLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLAXLIXRXRLXKQD

SEQ ID NO: 331472 - protein, 22 aa, Artificial Sequence
  Description of Artificial Sequence: Synthetic peptide
  Seed: LLVLMAVVLASLIYRRRLMKQD (PMEL_HUMAN)
  Core: LIYRRRLMK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASXIYXRXLMXQD

SEQ ID NO: 331473 - protein, 23 aa, Artificial Sequence
  Description of Artificial Sequence: Synthetic peptide
  Seed: LLVLMAVVLASLIYRRRLMKQDF (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLMKQDF

SEQ ID NO: 331474 - protein, 23 aa, Artificial Sequence
  Description of Artificial Sequence: Synthetic peptide
  Seed: LLVLMAVVLASLIYRRRLMKQDF (PMEL_HUMAN)
  Core: AVVLASLIY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMXVVXAXLIXRRRLMKQDF

SEQ ID NO: 331475 - protein, 23 aa, Artificial Sequence
  Description of Artificial Sequence: Synthetic peptide
  Seed: LLVLMAVVLASLIYRRRLMKQDF (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLMKQDF

SEQ ID NO: 331476 - protein, 23 aa, Artificial Sequence
  Description of Artificial Sequence: Synthetic peptide
  Seed: LLVLMAVVLASLIYRRRLMKQDF (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLMKQDF

SEQ ID NO: 331477 - protein, 23 aa, Artificial Sequence
  Description of Artificial Sequence: Synthetic peptide
  Seed: LLVLMAVVLASLIYRRRLMKQDF (PMEL_HUMAN)
  Core: ASLIYRRRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLXSLXYXRRXMKQDF

SEQ ID NO: 331478 - protein, 23 aa, Artificial Sequence
  Description of Artificial Sequence: Synthetic peptide
  Seed: LLVLMAVVLASLIYRRRLMKQDF (PMEL_HUMAN)
  Core: SLIYRRRLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLAXLIXRXRLXKQDF

SEQ ID NO: 331479 - protein, 23 aa, Artificial Sequence
  Description of Artificial Sequence: Synthetic peptide
  Seed: LLVLMAVVLASLIYRRRLMKQDF (PMEL_HUMAN)
  Core: LIYRRRLMK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASXIYXRXLMXQDF

SEQ ID NO: 331480 - protein, 23 aa, Artificial Sequence
  Description of Artificial Sequence: Synthetic peptide
  Seed: LLVLMAVVLASLIYRRRLMKQDF (PMEL_HUMAN)
  Core: IYRRRLMKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLXYRXRXMKXDF

SEQ ID NO: 331481 - protein, 23 aa, Artificial Sequence
  Description of Artificial Sequence: Synthetic peptide
  Seed: LLVLMAVVLASLIYRRRLMKQDF (PMEL_HUMAN)
  Core: YRRRLMKQD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLIXRRXLXKQXF

SEQ ID NO: 331482 - protein, 24 aa, Artificial Sequence
  Description of Artificial Sequence: Synthetic peptide
  Seed: LLVLMAVVLASLIYRRRLMKQDFS (PMEL_HUMAN)
  Core: VLMAVVLAS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LLXLMXVXLAXLIYRRRLMKQDFS

SEQ ID NO: 331483 - protein, 24 aa, Artificial Sequence
  Description of Artificial Sequence: Synthetic peptide
  Seed: LLVLMAVVLASLIYRRRLMKQDFS (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLMKQDFS

SEQ ID NO: 331484 - protein, 24 aa, Artificial Sequence
  Description of Artificial Sequence: Synthetic peptide
  Seed: LLVLMAVVLASLIYRRRLMKQDFS (PMEL_HUMAN)
  Core: AVVLASLIY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMXVVXAXLIXRRRLMKQDFS

SEQ ID NO: 331485 - protein, 24 aa, Artificial Sequence
  Description of Artificial Sequence: Synthetic peptide
  Seed: LLVLMAVVLASLIYRRRLMKQDFS (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLMKQDFS

SEQ ID NO: 331486 - protein, 24 aa, Artificial Sequence
  Description of Artificial Sequence: Synthetic peptide
  Seed: LLVLMAVVLASLIYRRRLMKQDFS (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLMKQDFS

SEQ ID NO: 331487 - protein, 24 aa, Artificial Sequence
  Description of Artificial Sequence: Synthetic peptide
  Seed: LLVLMAVVLASLIYRRRLMKQDFS (PMEL_HUMAN)
  Core: ASLIYRRRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLXSLXYXRRXMKQDFS

SEQ ID NO: 331488 - protein, 24 aa, Artificial Sequence
  Description of Artificial Sequence: Synthetic peptide
  Seed: LLVLMAVVLASLIYRRRLMKQDFS (PMEL_HUMAN)
  Core: SLIYRRRLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLAXLIXRXRLXKQDFS

SEQ ID NO: 331489 - protein, 24 aa, Artificial Sequence
  Description of Artificial Sequence: Synthetic peptide
  Seed: LLVLMAVVLASLIYRRRLMKQDFS (PMEL_HUMAN)
  Core: LIYRRRLMK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASXIYXRXLMXQDFS

SEQ ID NO: 331490 - protein, 24 aa, Artificial Sequence
  Description of Artificial Sequence: Synthetic peptide
  Seed: LLVLMAVVLASLIYRRRLMKQDFS (PMEL_HUMAN)
  Core: IYRRRLMKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLXYRXRXMKXDFS

SEQ ID NO: 331491 - protein, 24 aa, Artificial Sequence
  Description of Artificial Sequence: Synthetic peptide
  Seed: LLVLMAVVLASLIYRRRLMKQDFS (PMEL_HUMAN)
  Core: YRRRLMKQD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLIXRRXLXKQXFS

SEQ ID NO: 331492 - protein, 25 aa, Artificial Sequence
  Description of Artificial Sequence: Synthetic peptide
  Seed: LLVLMAVVLASLIYRRRLMKQDFSV (PMEL_HUMAN)
  Core: MAVVLASLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LLVLXAVXLXSLXYRRRLMKQDFSV

SEQ ID NO: 331493 - protein, 25 aa, Artificial Sequence
  Description of Artificial Sequence: Synthetic peptide
  Seed: LLVLMAVVLASLIYRRRLMKQDFSV (PMEL_HUMAN)
  Core: AVVLASLIY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMXVVXAXLIXRRRLMKQDFSV

SEQ ID NO: 331494 - protein, 25 aa, Artificial Sequence
  Description of Artificial Sequence: Synthetic peptide
  Seed: LLVLMAVVLASLIYRRRLMKQDFSV (PMEL_HUMAN)
  Core: VLASLIYRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVXLAXLXYRXRLMKQDFSV

SEQ ID NO: 331495 - protein, 25 aa, Artificial Sequence
  Description of Artificial Sequence: Synthetic peptide
  Seed: LLVLMAVVLASLIYRRRLMKQDFSV (PMEL_HUMAN)
  Core: LASLIYRRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVXASXIXRRXLMKQDFSV

SEQ ID NO: 331496 - protein, 25 aa, Artificial Sequence
  Description of Artificial Sequence: Synthetic peptide
  Seed: LLVLMAVVLASLIYRRRLMKQDFSV (PMEL_HUMAN)
  Core: ASLIYRRRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLXSLXYXRRXMKQDFSV

SEQ ID NO: 331497 - protein, 25 aa, Artificial Sequence
  Description of Artificial Sequence: Synthetic peptide
  Seed: LLVLMAVVLASLIYRRRLMKQDFSV (PMEL_HUMAN)
  Core: SLIYRRRLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLAXLIXRXRLXKQDFSV

SEQ ID NO: 331498 - protein, 25 aa, Artificial Sequence
  Description of Artificial Sequence: Synthetic peptide
  Seed: LLVLMAVVLASLIYRRRLMKQDFSV (PMEL_HUMAN)
  Core: LIYRRRLMK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASXIYXRXLMXQDFSV

SEQ ID NO: 331499 - protein, 25 aa, Artificial Sequence
  Description of Artificial Sequence: Synthetic peptide
  Seed: LLVLMAVVLASLIYRRRLMKQDFSV (PMEL_HUMAN)
  Core: IYRRRLMKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLXYRXRXMKXDFSV

SEQ ID NO: 331500 - protein, 25 aa, Artificial Sequence
  Description of Artificial Sequence: Synthetic peptide
  Seed: LLVLMAVVLASLIYRRRLMKQDFSV (PMEL_HUMAN)
  Core: YRRRLMKQD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLIXRRXLXKQXFSV

SEQ ID NO: 331501 - protein, 25 aa, Artificial Sequence
  Description of Artificial Sequence: Synthetic peptide
  Seed: LLVLMAVVLASLIYRRRLMKQDFSV (PMEL_HUMAN)
  Core: RRLMKQDFS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLIYRXRLXKXDFXV

SEQ ID NO: 331502 - protein, 25 aa, Artificial Sequence
  Description of Artificial Sequence: Synthetic peptide
  Seed: LLVLMAVVLASLIYRRRLMKQDFSV (PMEL_HUMAN)
  Core: RLMKQDFSV
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LLVLMAVVLASLIYRRXLMXQXFSX

SEQ ID NO: 331503 - protein, 13 aa, Artificial Sequence
  Description of Artificial Sequence: Synthetic peptide
  Seed: LMAVVLASLIYRR (PMEL_HUMAN)
  Core: MAVVLASLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXAVXLXSLXYRR

SEQ ID NO: 331504 - protein, 13 aa, Artificial Sequence
  Description of Artificial Sequence: Synthetic peptide
  Seed: LMAVVLASLIYRR (PMEL_HUMAN)
  Core: VVLASLIYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LMAXVLXSXIYXR

SEQ ID NO: 331505 - protein, 13 aa, Artificial Sequence
  Description of Artificial Sequence: Synthetic peptide
  Seed: LMAVVLASLIYRR (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRX

SEQ ID NO: 331506 - protein, 14 aa, Artificial Sequence
  Description of Artificial Sequence: Synthetic peptide
  Seed: LMAVVLASLIYRRR (PMEL_HUMAN)
  Core: AVVLASLIY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LMXVVXAXLIXRRR

SEQ ID NO: 331507 - protein, 14 aa, Artificial Sequence
  Description of Artificial Sequence: Synthetic peptide
  Seed: LMAVVLASLIYRRR (PMEL_HUMAN)
  Core: VVLASLIYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LMAXVLXSXIYXRR

SEQ ID NO: 331508 - protein, 14 aa, Artificial Sequence
  Description of Artificial Sequence: Synthetic peptide
  Seed: LMAVVLASLIYRRR (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXR

SEQ ID NO: 331509 - protein, 14 aa, Artificial Sequence
  Description of Artificial Sequence: Synthetic peptide
  Seed: LMAVVLASLIYRRR (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRX

SEQ ID NO: 331510 - protein, 15 aa, Artificial Sequence
  Description of Artificial Sequence: Synthetic peptide
  Seed: LMAVVLASLIYRRRL (PMEL_HUMAN)
  Core: MAVVLASLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXAVXLXSLXYRRRL

SEQ ID NO: 331511 - protein, 15 aa, Artificial Sequence
  Description of Artificial Sequence: Synthetic peptide
  Seed: LMAVVLASLIYRRRL (PMEL_HUMAN)
  Core: AVVLASLIY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LMXVVXAXLIXRRRL

SEQ ID NO: 331512 - protein, 15 aa, Artificial Sequence
  Description of Artificial Sequence: Synthetic peptide
  Seed: LMAVVLASLIYRRRL (PMEL_HUMAN)
  Core: VVLASLIYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LMAXVLXSXIYXRRL

SEQ ID NO: 331513 - protein, 15 aa, Artificial Sequence
  Description of Artificial Sequence: Synthetic peptide
  Seed: LMAVVLASLIYRRRL (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRL

SEQ ID NO: 331514 - protein, 15 aa, Artificial Sequence
  Description of Artificial Sequence: Synthetic peptide
  Seed: LMAVVLASLIYRRRL (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXL

SEQ ID NO: 331515 - protein, 16 aa, Artificial Sequence
  Description of Artificial Sequence: Synthetic peptide
  Seed: LMAVVLASLIYRRRLM (PMEL_HUMAN)
  Core: AVVLASLIY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LMXVVXAXLIXRRRLM

SEQ ID NO: 331516 - protein, 16 aa, Artificial Sequence
  Description of Artificial Sequence: Synthetic peptide
  Seed: LMAVVLASLIYRRRLM (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLM

SEQ ID NO: 331517 - protein, 16 aa, Artificial Sequence
  Description of Artificial Sequence: Synthetic peptide
  Seed: LMAVVLASLIYRRRLM (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLM

SEQ ID NO: 331518 - protein, 17 aa, Artificial Sequence
  Description of Artificial Sequence: Synthetic peptide
  Seed: LMAVVLASLIYRRRLMK (PMEL_HUMAN)
  Core: VVLASLIYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LMAXVLXSXIYXRRLMK

SEQ ID NO: 331519 - protein, 17 aa, Artificial Sequence
  Description of Artificial Sequence: Synthetic peptide
  Seed: LMAVVLASLIYRRRLMK (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMK

SEQ ID NO: 331520 - protein, 17 aa, Artificial Sequence
  Description of Artificial Sequence: Synthetic peptide
  Seed: LMAVVLASLIYRRRLMK (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMK

SEQ ID NO: 331521 - protein, 17 aa, Artificial Sequence
  Description of Artificial Sequence: Synthetic peptide
  Seed: LMAVVLASLIYRRRLMK (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMK

SEQ ID NO: 331522 - protein, 17 aa, Artificial Sequence
  Description of Artificial Sequence: Synthetic peptide
  Seed: LMAVVLASLIYRRRLMK (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXK

SEQ ID NO: 331523 - protein, 18 aa, Artificial Sequence
  Description of Artificial Sequence: Synthetic peptide
  Seed: LMAVVLASLIYRRRLMKQ (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQ

SEQ ID NO: 331524 - protein, 18 aa, Artificial Sequence
  Description of Artificial Sequence: Synthetic peptide
  Seed: LMAVVLASLIYRRRLMKQ (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQ

SEQ ID NO: 331525 - protein, 18 aa, Artificial Sequence
  Description of Artificial Sequence: Synthetic peptide
  Seed: LMAVVLASLIYRRRLMKQ (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQ

SEQ ID NO: 331526 - protein, 18 aa, Artificial Sequence
  Description of Artificial Sequence: Synthetic peptide
  Seed: LMAVVLASLIYRRRLMKQ (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQ

SEQ ID NO: 331527 - protein, 18 aa, Artificial Sequence
  Description of Artificial Sequence: Synthetic peptide
  Seed: LMAVVLASLIYRRRLMKQ (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQ

SEQ ID NO: 331528 - protein, 19 aa, Artificial Sequence
  Description of Artificial Sequence: Synthetic peptide
  Seed: LMAVVLASLIYRRRLMKQD (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQD

SEQ ID NO: 331529 - protein, 19 aa, Artificial Sequence
  Description of Artificial Sequence: Synthetic peptide
  Seed: LMAVVLASLIYRRRLMKQD (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQD

SEQ ID NO: 331530 - protein, 19 aa, Artificial Sequence
  Description of Artificial Sequence: Synthetic peptide
  Seed: LMAVVLASLIYRRRLMKQD (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQD

SEQ ID NO: 331531 - protein, 19 aa, Artificial Sequence
  Description of Artificial Sequence: Synthetic peptide
  Seed: LMAVVLASLIYRRRLMKQD (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQD

SEQ ID NO: 331532 - protein, 19 aa, Artificial Sequence
  Description of Artificial Sequence: Synthetic peptide
  Seed: LMAVVLASLIYRRRLMKQD (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQD

SEQ ID NO: 331533 - protein, 19 aa, Artificial Sequence
  Description of Artificial Sequence: Synthetic peptide
  Seed: LMAVVLASLIYRRRLMKQD (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXD

SEQ ID NO: 331534 - protein, 20 aa, Artificial Sequence
  Description of Artificial Sequence: Synthetic peptide
  Seed: LMAVVLASLIYRRRLMKQDF (PMEL_HUMAN)
  Core: VVLASLIYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LMAXVLXSXIYXRRLMKQDF

SEQ ID NO: 331535 - protein, 20 aa, Artificial Sequence
  Description of Artificial Sequence: Synthetic peptide
  Seed: LMAVVLASLIYRRRLMKQDF (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQDF

SEQ ID NO: 331536 - protein, 20 aa, Artificial Sequence
  Description of Artificial Sequence: Synthetic peptide
  Seed: LMAVVLASLIYRRRLMKQDF (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQDF

SEQ ID NO: 331537 - protein, 20 aa, Artificial Sequence
  Description of Artificial Sequence: Synthetic peptide
  Seed: LMAVVLASLIYRRRLMKQDF (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQDF

SEQ ID NO: 331538 - protein, 20 aa, Artificial Sequence
  Description of Artificial Sequence: Synthetic peptide
  Seed: LMAVVLASLIYRRRLMKQDF (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQDF

SEQ ID NO: 331539 - protein, 20 aa, Artificial Sequence
  Description of Artificial Sequence: Synthetic peptide
  Seed: LMAVVLASLIYRRRLMKQDF (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQDF

SEQ ID NO: 331540 - protein, 20 aa, Artificial Sequence
  Description of Artificial Sequence: Synthetic peptide
  Seed: LMAVVLASLIYRRRLMKQDF (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXDF

SEQ ID NO: 331541 - protein, 20 aa, Artificial Sequence
  Description of Artificial Sequence: Synthetic peptide
  Seed: LMAVVLASLIYRRRLMKQDF (PMEL_HUMAN)
  Core: YRRRLMKQD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIXRRXLXKQXF

SEQ ID NO: 331542 - protein, 21 aa, Artificial Sequence
  Description of Artificial Sequence: Synthetic peptide
  Seed: LMAVVLASLIYRRRLMKQDFS (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQDFS

SEQ ID NO: 331543 - protein, 21 aa, Artificial Sequence
  Description of Artificial Sequence: Synthetic peptide
  Seed: LMAVVLASLIYRRRLMKQDFS (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQDFS

SEQ ID NO: 331544 - protein, 21 aa, Artificial Sequence
  Description of Artificial Sequence: Synthetic peptide
  Seed: LMAVVLASLIYRRRLMKQDFS (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQDFS

SEQ ID NO: 331545 - protein, 21 aa, Artificial Sequence
  Description of Artificial Sequence: Synthetic peptide
  Seed: LMAVVLASLIYRRRLMKQDFS (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQDFS

SEQ ID NO: 331546 - protein, 21 aa, Artificial Sequence
  Description of Artificial Sequence: Synthetic peptide
  Seed: LMAVVLASLIYRRRLMKQDFS (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQDFS

SEQ ID NO: 331547 - protein, 21 aa, Artificial Sequence
  Description of Artificial Sequence: Synthetic peptide
  Seed: LMAVVLASLIYRRRLMKQDFS (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXDFS

SEQ ID NO: 331548 - protein, 21 aa, Artificial Sequence
  Description of Artificial Sequence: Synthetic peptide
  Seed: LMAVVLASLIYRRRLMKQDFS (PMEL_HUMAN)
  Core: YRRRLMKQD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIXRRXLXKQXFS

SEQ ID NO: 331549 - protein, 22 aa, Artificial Sequence
  Description of Artificial Sequence: Synthetic peptide
  Seed: LMAVVLASLIYRRRLMKQDFSV (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQDFSV

SEQ ID NO: 331550 - protein, 22 aa, Artificial Sequence
  Description of Artificial Sequence: Synthetic peptide
  Seed: LMAVVLASLIYRRRLMKQDFSV (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQDFSV

SEQ ID NO: 331551 - protein, 22 aa, Artificial Sequence
  Description of Artificial Sequence: Synthetic peptide
  Seed: LMAVVLASLIYRRRLMKQDFSV (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQDFSV

SEQ ID NO: 331552 - protein, 22 aa, Artificial Sequence
  Description of Artificial Sequence: Synthetic peptide
  Seed: LMAVVLASLIYRRRLMKQDFSV (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQDFSV

SEQ ID NO: 331553 - protein, 22 aa, Artificial Sequence
  Description of Artificial Sequence: Synthetic peptide
  Seed: LMAVVLASLIYRRRLMKQDFSV (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQDFSV

SEQ ID NO: 331554 - protein, 22 aa, Artificial Sequence
  Description of Artificial Sequence: Synthetic peptide
  Seed: LMAVVLASLIYRRRLMKQDFSV (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXDFSV

SEQ ID NO: 331555 - protein, 22 aa, Artificial Sequence
  Description of Artificial Sequence: Synthetic peptide
  Seed: LMAVVLASLIYRRRLMKQDFSV (PMEL_HUMAN)
  Core: YRRRLMKQD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIXRRXLXKQXFSV

SEQ ID NO: 331556 - protein, 23 aa, Artificial Sequence
  Description of Artificial Sequence: Synthetic peptide
  Seed: LMAVVLASLIYRRRLMKQDFSVP (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQDFSVP

SEQ ID NO: 331557 - protein, 23 aa, Artificial Sequence
  Description of Artificial Sequence: Synthetic peptide
  Seed: LMAVVLASLIYRRRLMKQDFSVP (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQDFSVP

SEQ ID NO: 331558 - protein, 23 aa, Artificial Sequence
  Description of Artificial Sequence: Synthetic peptide
  Seed: LMAVVLASLIYRRRLMKQDFSVP (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQDFSVP

SEQ ID NO: 331559 - protein, 23 aa, Artificial Sequence
  Description of Artificial Sequence: Synthetic peptide
  Seed: LMAVVLASLIYRRRLMKQDFSVP (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQDFSVP

SEQ ID NO: 331560 - protein, 23 aa, Artificial Sequence
  Description of Artificial Sequence: Synthetic peptide
  Seed: LMAVVLASLIYRRRLMKQDFSVP (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQDFSVP

SEQ ID NO: 331561 - protein, 23 aa, Artificial Sequence
  Description of Artificial Sequence: Synthetic peptide
  Seed: LMAVVLASLIYRRRLMKQDFSVP (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXDFSVP

SEQ ID NO: 331562 - protein, 23 aa, Artificial Sequence
  Description of Artificial Sequence: Synthetic peptide
  Seed: LMAVVLASLIYRRRLMKQDFSVP (PMEL_HUMAN)
  Core: YRRRLMKQD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIXRRXLXKQXFSVP

SEQ ID NO: 331563 - protein, 23 aa, Artificial Sequence
  Description of Artificial Sequence: Synthetic peptide
  Seed: LMAVVLASLIYRRRLMKQDFSVP (PMEL_HUMAN)
  Core: RRLMKQDFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRXRLXKXDFXVP

SEQ ID NO: 331564 - protein, 23 aa, Artificial Sequence
  Description of Artificial Sequence: Synthetic peptide
  Seed: LMAVVLASLIYRRRLMKQDFSVP (PMEL_HUMAN)
  Core: RLMKQDFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRRXLMXQXFSXP

SEQ ID NO: 331565 - protein, 24 aa, Artificial Sequence
  Description of Artificial Sequence: Synthetic peptide
  Seed: LMAVVLASLIYRRRLMKQDFSVPQ (PMEL_HUMAN)
  Core: VVLASLIYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LMAXVLXSXIYXRRLMKQDFSVPQ

SEQ ID NO: 331566 - protein, 24 aa, Artificial Sequence
  Description of Artificial Sequence: Synthetic peptide
  Seed: LMAVVLASLIYRRRLMKQDFSVPQ (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQDFSVPQ

SEQ ID NO: 331567 - protein, 24 aa, Artificial Sequence
  Description of Artificial Sequence: Synthetic peptide
  Seed: LMAVVLASLIYRRRLMKQDFSVPQ (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQDFSVPQ

SEQ ID NO: 331568 - protein, 24 aa, Artificial Sequence
  Description of Artificial Sequence: Synthetic peptide
  Seed: LMAVVLASLIYRRRLMKQDFSVPQ (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQDFSVPQ

SEQ ID NO: 331569 - protein, 24 aa, Artificial Sequence
  Description of Artificial Sequence: Synthetic peptide
  Seed: LMAVVLASLIYRRRLMKQDFSVPQ (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQDFSVPQ

SEQ ID NO: 331570 - protein, 24 aa, Artificial Sequence
  Description of Artificial Sequence: Synthetic peptide
  Seed: LMAVVLASLIYRRRLMKQDFSVPQ (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQDFSVPQ

SEQ ID NO: 331571 - protein, 24 aa, Artificial Sequence
  Description of Artificial Sequence: Synthetic peptide
  Seed: LMAVVLASLIYRRRLMKQDFSVPQ (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXDFSVPQ

SEQ ID NO: 331572 - protein, 24 aa, Artificial Sequence
  Description of Artificial Sequence: Synthetic peptide
  Seed: LMAVVLASLIYRRRLMKQDFSVPQ (PMEL_HUMAN)
  Core: YRRRLMKQD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIXRRXLXKQXFSVPQ

SEQ ID NO: 331573 - protein, 24 aa, Artificial Sequence
  Description of Artificial Sequence: Synthetic peptide
  Seed: LMAVVLASLIYRRRLMKQDFSVPQ (PMEL_HUMAN)
  Core: RRLMKQDFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRXRLXKXDFXVPQ

SEQ ID NO: 331574 - protein, 24 aa, Artificial Sequence
  Description of Artificial Sequence: Synthetic peptide
  Seed: LMAVVLASLIYRRRLMKQDFSVPQ (PMEL_HUMAN)
  Core: RLMKQDFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRRXLMXQXFSXPQ

SEQ ID NO: 331575 - protein, 25 aa, Artificial Sequence
  Description of Artificial Sequence: Synthetic peptide
  Seed: LMAVVLASLIYRRRLMKQDFSVPQL (PMEL_HUMAN)
  Core: VLASLIYRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMAVXLAXLXYRXRLMKQDFSVPQL

SEQ ID NO: 331576 - protein, 25 aa, Artificial Sequence
  Description of Artificial Sequence: Synthetic peptide
  Seed: LMAVVLASLIYRRRLMKQDFSVPQL (PMEL_HUMAN)
  Core: LASLIYRRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVXASXIXRRXLMKQDFSVPQL

SEQ ID NO: 331577 - protein, 25 aa, Artificial Sequence
  Description of Artificial Sequence: Synthetic peptide
  Seed: LMAVVLASLIYRRRLMKQDFSVPQL (PMEL_HUMAN)
  Core: ASLIYRRRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLXSLXYXRRXMKQDFSVPQL

SEQ ID NO: 331578 - protein, 25 aa, Artificial Sequence
  Description of Artificial Sequence: Synthetic peptide
  Seed: LMAVVLASLIYRRRLMKQDFSVPQL (PMEL_HUMAN)
  Core: SLIYRRRLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLAXLIXRXRLXKQDFSVPQL

SEQ ID NO: 331579 - protein, 25 aa, Artificial Sequence
  Description of Artificial Sequence: Synthetic peptide
  Seed: LMAVVLASLIYRRRLMKQDFSVPQL (PMEL_HUMAN)
  Core: LIYRRRLMK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASXIYXRXLMXQDFSVPQL

SEQ ID NO: 331580 - protein, 25 aa, Artificial Sequence
  Description of Artificial Sequence: Synthetic peptide
  Seed: LMAVVLASLIYRRRLMKQDFSVPQL (PMEL_HUMAN)
  Core: IYRRRLMKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLXYRXRXMKXDFSVPQL

SEQ ID NO: 331581 - protein, 25 aa, Artificial Sequence
  Description of Artificial Sequence: Synthetic peptide
  Seed: LMAVVLASLIYRRRLMKQDFSVPQL (PMEL_HUMAN)
  Core: YRRRLMKQD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIXRRXLXKQXFSVPQL

SEQ ID NO: 331582 - protein, 25 aa, Artificial Sequence
  Description of Artificial Sequence: Synthetic peptide
  Seed: LMAVVLASLIYRRRLMKQDFSVPQL (PMEL_HUMAN)
  Core: RRLMKQDFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRXRLXKXDFXVPQL

SEQ ID NO: 331583 - protein, 25 aa, Artificial Sequence
  Description of Artificial Sequence: Synthetic peptide
  Seed: LMAVVLASLIYRRRLMKQDFSVPQL (PMEL_HUMAN)
  Core: RLMKQDFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRRXLMXQXFSXPQL

SEQ ID NO: 331584 - protein, 25 aa, Artificial Sequence
  Description of Artificial Sequence: Synthetic peptide
  Seed: LMAVVLASLIYRRRLMKQDFSVPQL (PMEL_HUMAN)
  Core: LMKQDFSVP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRRRXMKXDXSVXQL

SEQ ID NO: 331585 - protein, 25 aa, Artificial Sequence
  Description of Artificial Sequence: Synthetic peptide
  Seed: LMAVVLASLIYRRRLMKQDFSVPQL (PMEL_HUMAN)
  Core: MKQDFSVPQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LMAVVLASLIYRRRLXKQXFXVPXL

SEQ ID NO: 331586 - protein, 15 aa, Artificial Sequence
  Description of Artificial Sequence: Synthetic peptide
  Seed: LMKQDFSVPQLPHSS (PMEL_HUMAN)
  Core: MKQDFSVPQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXKQXFXVPXLPHSS

SEQ ID NO: 331587 - protein, 15 aa, Artificial Sequence
  Description of Artificial Sequence: Synthetic peptide
  Seed: LMKQDFSVPQLPHSS (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXS

SEQ ID NO: 331588 - protein, 16 aa, Artificial Sequence
  Description of Artificial Sequence: Synthetic peptide
  Seed: LMKQDFSVPQLPHSSS (PMEL_HUMAN)
  Core: DFSVPQLPH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LMKQXFSXPXLPXSSS

SEQ ID NO: 331589 - protein, 20 aa, Artificial Sequence
  Description of Artificial Sequence: Synthetic peptide
  Seed: LMKQDFSVPQLPHSSSHWLR (PMEL_HUMAN)
  Core: MKQDFSVPQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXKQXFXVPXLPHSSSHWLR

SEQ ID NO: 331590 - protein, 20 aa, Artificial Sequence
  Description of Artificial Sequence: Synthetic peptide
  Seed: LMKQDFSVPQLPHSSSHWLR (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXSSHWLR

SEQ ID NO: 331591 - protein, 21 aa, Artificial Sequence
  Description of Artificial Sequence: Synthetic peptide
  Seed: LMKQDFSVPQLPHSSSHWLRL (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXSSHWLRL

SEQ ID NO: 331592 - protein, 22 aa, Artificial Sequence
  Description of Artificial Sequence: Synthetic peptide
  Seed: LMKQDFSVPQLPHSSSHWLRLP (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXSSHWLRLP

SEQ ID NO: 331593 - protein, 22 aa, Artificial Sequence
  Description of Artificial Sequence: Synthetic peptide
  Seed: LMKQDFSVPQLPHSSSHWLRLP (PMEL_HUMAN)
  Core: HSSSHWLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQLPXSSXHXLRXP

SEQ ID NO: 331594 - protein, 23 aa, Artificial Sequence
  Description of Artificial Sequence: Synthetic peptide
  Seed: LMKQDFSVPQLPHSSSHWLRLPR (PMEL_HUMAN)
  Core: MKQDFSVPQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXKQXFXVPXLPHSSSHWLRLPR

SEQ ID NO: 331595 - protein, 23 aa, Artificial Sequence
  Description of Artificial Sequence: Synthetic peptide
  Seed: LMKQDFSVPQLPHSSSHWLRLPR (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXSSHWLRLPR

SEQ ID NO: 331596 - protein, 23 aa, Artificial Sequence
  Description of Artificial Sequence: Synthetic peptide
  Seed: LMKQDFSVPQLPHSSSHWLRLPR (PMEL_HUMAN)
  Core: HSSSHWLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQLPXSSXHXLRXPR

SEQ ID NO: 331597 - protein, 24 aa, Artificial Sequence
  Description of Artificial Sequence: Synthetic peptide
  Seed: LMKQDFSVPQLPHSSSHWLRLPRI (PMEL_HUMAN)
  Core: MKQDFSVPQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXKQXFXVPXLPHSSSHWLRLPRI

SEQ ID NO: 331598 - protein, 24 aa, Artificial Sequence
  Description of Artificial Sequence: Synthetic peptide
  Seed: LMKQDFSVPQLPHSSSHWLRLPRI (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXSSHWLRLPRI

SEQ ID NO: 331599 - protein, 24 aa, Artificial Sequence
  Description of Artificial Sequence: Synthetic peptide
  Seed: LMKQDFSVPQLPHSSSHWLRLPRI (PMEL_HUMAN)
  Core: LPHSSSHWL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQXPHXSXHWXRLPRI

SEQ ID NO: 331600 - protein, 24 aa, Artificial Sequence
  Description of Artificial Sequence: Synthetic peptide
  Seed: LMKQDFSVPQLPHSSSHWLRLPRI (PMEL_HUMAN)
  Core: PHSSSHWLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQLXHSXSXWLXLPRI

SEQ ID NO: 331601 - protein, 24 aa, Artificial Sequence
  Description of Artificial Sequence: Synthetic peptide
  Seed: LMKQDFSVPQLPHSSSHWLRLPRI (PMEL_HUMAN)
  Core: HSSSHWLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQLPXSSXHXLRXPRI

SEQ ID NO: 331602 - protein, 25 aa, Artificial Sequence
  Description of Artificial Sequence: Synthetic peptide
  Seed: LMKQDFSVPQLPHSSSHWLRLPRIF (PMEL_HUMAN)
  Core: MKQDFSVPQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXKQXFXVPXLPHSSSHWLRLPRIF

SEQ ID NO: 331603 - protein, 25 aa, Artificial Sequence
  Description of Artificial Sequence: Synthetic peptide
  Seed: LMKQDFSVPQLPHSSSHWLRLPRIF (PMEL_HUMAN)
  Core: FSVPQLPHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDXSVXQXPHXSSHWLRLPRIF

SEQ ID NO: 331604 - protein, 25 aa, Artificial Sequence
  Description of Artificial Sequence: Synthetic peptide
  Seed: LMKQDFSVPQLPHSSSHWLRLPRIF (PMEL_HUMAN)
  Core: LPHSSSHWL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQXPHXSXHWXRLPRIF

SEQ ID NO: 331605 - protein, 25 aa, Artificial Sequence
  Description of Artificial Sequence: Synthetic peptide
  Seed: LMKQDFSVPQLPHSSSHWLRLPRIF (PMEL_HUMAN)
  Core: PHSSSHWLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQLXHSXSXWLXLPRIF

SEQ ID NO: 331606 - protein, 25 aa, Artificial Sequence
  Description of Artificial Sequence: Synthetic peptide
  Seed: LMKQDFSVPQLPHSSSHWLRLPRIF (PMEL_HUMAN)
  Core: HSSSHWLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LMKQDFSVPQLPXSSXHXLRXPRIF

SEQ ID NO: 331607 - protein, 22 aa, Artificial Sequence
  Description of Artificial Sequence: Synthetic peptide
  Seed: LNFPGSQKVLPDGQVIWVNNTI (PMEL_HUMAN)
  Core: QKVLPDGQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSXKVXPXGQXIWVNNTI

SEQ ID NO: 331608 - protein, 23 aa, Artificial Sequence
  Description of Artificial Sequence: Synthetic peptide
  Seed: LNFPGSQKVLPDGQVIWVNNTII (PMEL_HUMAN)
  Core: VLPDGQVIW
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKXLPXGXVIXVNNTII

SEQ ID NO: 331609 - protein, 23 aa, Artificial Sequence
  Description of Artificial Sequence: Synthetic peptide
  Seed: LNFPGSQKVLPDGQVIWVNNTII (PMEL_HUMAN)
  Core: QVIWVNNTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGXVIXVXNTXI

SEQ ID NO: 331610 - protein, 24 aa, Artificial Sequence
  Description of Artificial Sequence: Synthetic peptide
  Seed: LNFPGSQKVLPDGQVIWVNNTIIN (PMEL_HUMAN)
  Core: QVIWVNNTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGXVIXVXNTXIN

SEQ ID NO: 331611 - protein, 24 aa, Artificial Sequence
  Description of Artificial Sequence: Synthetic peptide
  Seed: LNFPGSQKVLPDGQVIWVNNTIIN (PMEL_HUMAN)
  Core: VIWVNNTII
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGQXIWXNXTIXN

SEQ ID NO: 331612 - protein, 24 aa, Artificial Sequence
  Description of Artificial Sequence: Synthetic peptide
  Seed: LNFPGSQKVLPDGQVIWVNNTIIN (PMEL_HUMAN)
  Core: IWVNNTIIN
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGQVXWVXNXIIX

SEQ ID NO: 331613 - protein, 25 aa, Artificial Sequence
  Description of Artificial Sequence: Synthetic peptide
  Seed: LNFPGSQKVLPDGQVIWVNNTIING (PMEL_HUMAN)
  Core: QVIWVNNTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGXVIXVXNTXING

SEQ ID NO: 331614 - protein, 25 aa, Artificial Sequence
  Description of Artificial Sequence: Synthetic peptide
  Seed: LNFPGSQKVLPDGQVIWVNNTIING (PMEL_HUMAN)
  Core: VIWVNNTII
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGQXIWXNXTIXNG

SEQ ID NO: 331615 - protein, 25 aa, Artificial Sequence
  Description of Artificial Sequence: Synthetic peptide
  Seed: LNFPGSQKVLPDGQVIWVNNTIING (PMEL_HUMAN)
  Core: IWVNNTIIN
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LNFPGSQKVLPDGQVXWVXNXIIXG

SEQ ID NO: 331616 - protein, 13 aa, Artificial Sequence
  Description of Artificial Sequence: Synthetic peptide
  Seed: LNVSLADTNSLAV (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAX

SEQ ID NO: 331617 - protein, 14 aa, Artificial Sequence
  Description of Artificial Sequence: Synthetic peptide
  Seed: LNVSLADTNSLAVV (PMEL_HUMAN)
  Core: VSLADTNSL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LNXSLXDXNSXAVV

SEQ ID NO: 331618 - protein, 14 aa, Artificial Sequence
  Description of Artificial Sequence: Synthetic peptide
  Seed: LNVSLADTNSLAVV (PMEL_HUMAN)
  Core: SLADTNSLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LNVXLAXTXSLXVV

SEQ ID NO: 331619 - protein, 14 aa, Artificial Sequence
  Description of Artificial Sequence: Synthetic peptide
  Seed: LNVSLADTNSLAVV (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXV

SEQ ID NO: 331620 - protein, 15 aa, Artificial Sequence
  Description of Artificial Sequence: Synthetic peptide
  Seed: LNVSLADTNSLAVVS (PMEL_HUMAN)
  Core: VSLADTNSL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LNXSLXDXNSXAVVS

SEQ ID NO: 331621 - protein, 15 aa, Artificial Sequence
  Description of Artificial Sequence: Synthetic peptide
  Seed: LNVSLADTNSLAVVS (PMEL_HUMAN)
  Core: SLADTNSLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LNVXLAXTXSLXVVS

SEQ ID NO: 331622 - protein, 15 aa, Artificial Sequence
  Description of Artificial Sequence: Synthetic peptide
  Seed: LNVSLADTNSLAVVS (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVS

SEQ ID NO: 331623 - protein, 16 aa, Artificial Sequence
  Description of Artificial Sequence: Synthetic peptide
  Seed: LNVSLADTNSLAVVST (PMEL_HUMAN)
  Core: VSLADTNSL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LNXSLXDXNSXAVVST

SEQ ID NO: 331624 - protein, 16 aa, Artificial Sequence
  Description of Artificial Sequence: Synthetic peptide
  Seed: LNVSLADTNSLAVVST (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVST

SEQ ID NO: 331625 - protein, 16 aa, Artificial Sequence
  Description of Artificial Sequence: Synthetic peptide
  Seed: LNVSLADTNSLAVVST (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXT

SEQ ID NO: 331626 - protein, 17 aa, Artificial Sequence
  Description of Artificial Sequence: Synthetic peptide
  Seed: LNVSLADTNSLAVVSTQ (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQ

SEQ ID NO: 331627 - protein, 17 aa, Artificial Sequence
  Description of Artificial Sequence: Synthetic peptide
  Seed: LNVSLADTNSLAVVSTQ (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQ

SEQ ID NO: 331628 - protein, 17 aa, Artificial Sequence
  Description of Artificial Sequence: Synthetic peptide
  Seed: LNVSLADTNSLAVVSTQ (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTX

SEQ ID NO: 331629 - protein, 18 aa, Artificial Sequence
  Description of Artificial Sequence: Synthetic peptide
  Seed: LNVSLADTNSLAVVSTQL (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQL

SEQ ID NO: 331630 - protein, 18 aa, Artificial Sequence
  Description of Artificial Sequence: Synthetic peptide
  Seed: LNVSLADTNSLAVVSTQL (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQL

SEQ ID NO: 331631 - protein, 18 aa, Artificial Sequence
  Description of Artificial Sequence: Synthetic peptide
  Seed: LNVSLADTNSLAVVSTQL (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXL

SEQ ID NO: 331632 - protein, 19 aa, Artificial Sequence
  Description of Artificial Sequence: Synthetic peptide
  Seed: LNVSLADTNSLAVVSTQLI (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLI

SEQ ID NO: 331633 - protein, 19 aa, Artificial Sequence
  Description of Artificial Sequence: Synthetic peptide
  Seed: LNVSLADTNSLAVVSTQLI (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQLI

SEQ ID NO: 331634 - protein, 19 aa, Artificial Sequence
  Description of Artificial Sequence: Synthetic peptide
  Seed: LNVSLADTNSLAVVSTQLI (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLI

SEQ ID NO: 331635 - protein, 20 aa, Artificial Sequence
  Description of Artificial Sequence: Synthetic peptide
  Seed: LNVSLADTNSLAVVSTQLIM (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLIM

SEQ ID NO: 331636 - protein, 20 aa, Artificial Sequence
  Description of Artificial Sequence: Synthetic peptide
  Seed: LNVSLADTNSLAVVSTQLIM (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQLIM

SEQ ID NO: 331637 - protein, 20 aa, Artificial Sequence
  Description of Artificial Sequence: Synthetic peptide
  Seed: LNVSLADTNSLAVVSTQLIM (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLIM

SEQ ID NO: 331638 - protein, 20 aa, Artificial Sequence
  Description of Artificial Sequence: Synthetic peptide
  Seed: LNVSLADTNSLAVVSTQLIM (PMEL_HUMAN)
  Core: LAVVSTQLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSXAVXSXQLXM

SEQ ID NO: 331639 - protein, 21 aa, Artificial Sequence
  Description of Artificial Sequence: Synthetic peptide
  Seed: LNVSLADTNSLAVVSTQLIMP (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLIMP

SEQ ID NO: 331640 - protein, 21 aa, Artificial Sequence
  Description of Artificial Sequence: Synthetic peptide
  Seed: LNVSLADTNSLAVVSTQLIMP (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQLIMP

SEQ ID NO: 331641 - protein, 21 aa, Artificial Sequence
  Description of Artificial Sequence: Synthetic peptide
  Seed: LNVSLADTNSLAVVSTQLIMP (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLIMP

SEQ ID NO: 331642 - protein, 21 aa, Artificial Sequence
  Description of Artificial Sequence: Synthetic peptide
  Seed: LNVSLADTNSLAVVSTQLIMP (PMEL_HUMAN)
  Core: LAVVSTQLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSXAVXSXQLXMP

SEQ ID NO: 331643 - protein, 22 aa, Artificial Sequence
  Description of Artificial Sequence: Synthetic peptide
  Seed: LNVSLADTNSLAVVSTQLIMPG (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLIMPG

SEQ ID NO: 331644 - protein, 22 aa, Artificial Sequence
  Description of Artificial Sequence: Synthetic peptide
  Seed: LNVSLADTNSLAVVSTQLIMPG (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQLIMPG

SEQ ID NO: 331645 - protein, 22 aa, Artificial Sequence
  Description of Artificial Sequence: Synthetic peptide
  Seed: LNVSLADTNSLAVVSTQLIMPG (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLIMPG

SEQ ID NO: 331646 - protein, 22 aa, Artificial Sequence
  Description of Artificial Sequence: Synthetic peptide
  Seed: LNVSLADTNSLAVVSTQLIMPG (PMEL_HUMAN)
  Core: LAVVSTQLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSXAVXSXQLXMPG

SEQ ID NO: 331647 - protein, 23 aa, Artificial Sequence
  Description of Artificial Sequence: Synthetic peptide
  Seed: LNVSLADTNSLAVVSTQLIMPGQ (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLIMPGQ

SEQ ID NO: 331648 - protein, 23 aa, Artificial Sequence
  Description of Artificial Sequence: Synthetic peptide
  Seed: LNVSLADTNSLAVVSTQLIMPGQ (PMEL_HUMAN)
  Core: DTNSLAVVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLAXTNXLXVVXTQLIMPGQ

SEQ ID NO: 331649 - protein, 23 aa, Artificial Sequence
  Description of Artificial Sequence: Synthetic peptide
  Seed: LNVSLADTNSLAVVSTQLIMPGQ (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLIMPGQ

SEQ ID NO: 331650 - protein, 23 aa, Artificial Sequence
  Description of Artificial Sequence: Synthetic peptide
  Seed: LNVSLADTNSLAVVSTQLIMPGQ (PMEL_HUMAN)
  Core: LAVVSTQLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSXAVXSXQLXMPGQ

SEQ ID NO: 331651 - protein, 24 aa, Artificial Sequence
  Description of Artificial Sequence: Synthetic peptide
  Seed: LNVSLADTNSLAVVSTQLIMPGQE (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLIMPGQE

SEQ ID NO: 331652 - protein, 24 aa, Artificial Sequence
  Description of Artificial Sequence: Synthetic peptide
  Seed: LNVSLADTNSLAVVSTQLIMPGQE (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLIMPGQE

SEQ ID NO: 331653 - protein, 24 aa, Artificial Sequence
  Description of Artificial Sequence: Synthetic peptide
  Seed: LNVSLADTNSLAVVSTQLIMPGQE (PMEL_HUMAN)
  Core: LAVVSTQLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSXAVXSXQLXMPGQE

SEQ ID NO: 331654 - protein, 24 aa, Artificial Sequence
  Description of Artificial Sequence: Synthetic peptide
  Seed: LNVSLADTNSLAVVSTQLIMPGQE (PMEL_HUMAN)
  Core: VVSTQLIMP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSLAXVSXQXIMXGQE

SEQ ID NO: 331655 - protein, 24 aa, Artificial Sequence
  Description of Artificial Sequence: Synthetic peptide
  Seed: LNVSLADTNSLAVVSTQLIMPGQE (PMEL_HUMAN)
  Core: VSTQLIMPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSLAVXSTXLXMPXQE

SEQ ID NO: 331656 - protein, 25 aa, Artificial Sequence
  Description of Artificial Sequence: Synthetic peptide
  Seed: LNVSLADTNSLAVVSTQLIMPGQEA (PMEL_HUMAN)
  Core: LADTNSLAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LNVSXADXNXLAXVSTQLIMPGQEA

SEQ ID NO: 331657 - protein, 25 aa, Artificial Sequence
  Description of Artificial Sequence: Synthetic peptide
  Seed: LNVSLADTNSLAVVSTQLIMPGQEA (PMEL_HUMAN)
  Core: NSLAVVSTQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTXSLXVXSTXLIMPGQEA

SEQ ID NO: 331658 - protein, 25 aa, Artificial Sequence
  Description of Artificial Sequence: Synthetic peptide
  Seed: LNVSLADTNSLAVVSTQLIMPGQEA (PMEL_HUMAN)
  Core: LAVVSTQLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSXAVXSXQLXMPGQEA

SEQ ID NO: 331659 - protein, 25 aa, Artificial Sequence
  Description of Artificial Sequence: Synthetic peptide
  Seed: LNVSLADTNSLAVVSTQLIMPGQEA (PMEL_HUMAN)
  Core: VVSTQLIMP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSLAXVSXQXIMXGQEA

SEQ ID NO: 331660 - protein, 25 aa, Artificial Sequence
  Description of Artificial Sequence: Synthetic peptide
  Seed: LNVSLADTNSLAVVSTQLIMPGQEA (PMEL_HUMAN)
  Core: VSTQLIMPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LNVSLADTNSLAVXSTXLXMPXQEA

SEQ ID NO: 331661 - protein, 14 aa, Artificial Sequence
  Description of Artificial Sequence: Synthetic peptide
  Seed: LPDGQVIWVNNTII (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXI

SEQ ID NO: 331662 - protein, 14 aa, Artificial Sequence
  Description of Artificial Sequence: Synthetic peptide
  Seed: LPDGQVIWVNNTII (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIX

SEQ ID NO: 331663 - protein, 15 aa, Artificial Sequence
  Description of Artificial Sequence: Synthetic peptide
  Seed: LPDGQVIWVNNTIIN (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXIN

SEQ ID NO: 331664 - protein, 15 aa, Artificial Sequence
  Description of Artificial Sequence: Synthetic peptide
  Seed: LPDGQVIWVNNTIIN (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXN

SEQ ID NO: 331665 - protein, 15 aa, Artificial Sequence
  Description of Artificial Sequence: Synthetic peptide
  Seed: LPDGQVIWVNNTIIN (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIX

SEQ ID NO: 331666 - protein, 16 aa, Artificial Sequence
  Description of Artificial Sequence: Synthetic peptide
  Seed: LPDGQVIWVNNTIING (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXING

SEQ ID NO: 331667 - protein, 16 aa, Artificial Sequence
  Description of Artificial Sequence: Synthetic peptide
  Seed: LPDGQVIWVNNTIING (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNG

SEQ ID NO: 331668 - protein, 16 aa, Artificial Sequence
  Description of Artificial Sequence: Synthetic peptide
  Seed: LPDGQVIWVNNTIING (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXG

SEQ ID NO: 331669 - protein, 17 aa, Artificial Sequence
  Description of Artificial Sequence: Synthetic peptide
  Seed: LPDGQVIWVNNTIINGS (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGS

SEQ ID NO: 331670 - protein, 17 aa, Artificial Sequence
  Description of Artificial Sequence: Synthetic peptide
  Seed: LPDGQVIWVNNTIINGS (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGS

SEQ ID NO: 331671 - protein, 17 aa, Artificial Sequence
  Description of Artificial Sequence: Synthetic peptide
  Seed: LPDGQVIWVNNTIINGS (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGS

SEQ ID NO: 331672 - protein, 18 aa, Artificial Sequence
  Description of Artificial Sequence: Synthetic peptide
  Seed: LPDGQVIWVNNTIINGSQ (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQ

SEQ ID NO: 331673 - protein, 18 aa, Artificial Sequence
  Description of Artificial Sequence: Synthetic peptide
  Seed: LPDGQVIWVNNTIINGSQ (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQ

SEQ ID NO: 331674 - protein, 18 aa, Artificial Sequence
  Description of Artificial Sequence: Synthetic peptide
  Seed: LPDGQVIWVNNTIINGSQ (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQ

SEQ ID NO: 331675 - protein, 19 aa, Artificial Sequence
  Description of Artificial Sequence: Synthetic peptide
  Seed: LPDGQVIWVNNTIINGSQV (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQV

SEQ ID NO: 331676 - protein, 19 aa, Artificial Sequence
  Description of Artificial Sequence: Synthetic peptide
  Seed: LPDGQVIWVNNTIINGSQV (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQV

SEQ ID NO: 331677 - protein, 19 aa, Artificial Sequence
  Description of Artificial Sequence: Synthetic peptide
  Seed: LPDGQVIWVNNTIINGSQV (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQV

SEQ ID NO: 331678 - protein, 19 aa, Artificial Sequence
  Description of Artificial Sequence: Synthetic peptide
  Seed: LPDGQVIWVNNTIINGSQV (PMEL_HUMAN)
  Core: VNNTIINGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWXNNXIXNGXQV

SEQ ID NO: 331679 - protein, 20 aa, Artificial Sequence
  Description of Artificial Sequence: Synthetic peptide
  Seed: LPDGQVIWVNNTIINGSQVW (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQVW

SEQ ID NO: 331680 - protein, 20 aa, Artificial Sequence
  Description of Artificial Sequence: Synthetic peptide
  Seed: LPDGQVIWVNNTIINGSQVW (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQVW

SEQ ID NO: 331681 - protein, 20 aa, Artificial Sequence
  Description of Artificial Sequence: Synthetic peptide
  Seed: LPDGQVIWVNNTIINGSQVW (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQVW

SEQ ID NO: 331682 - protein, 20 aa, Artificial Sequence
  Description of Artificial Sequence: Synthetic peptide
  Seed: LPDGQVIWVNNTIINGSQVW (PMEL_HUMAN)
  Core: VNNTIINGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWXNNXIXNGXQVW

SEQ ID NO: 331683 - protein, 21 aa, Artificial Sequence
  Description of Artificial Sequence: Synthetic peptide
  Seed: LPDGQVIWVNNTIINGSQVWG (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQVWG

SEQ ID NO: 331684 - protein, 21 aa, Artificial Sequence
  Description of Artificial Sequence: Synthetic peptide
  Seed: LPDGQVIWVNNTIINGSQVWG (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQVWG

SEQ ID NO: 331685 - protein, 21 aa, Artificial Sequence
  Description of Artificial Sequence: Synthetic peptide
  Seed: LPDGQVIWVNNTIINGSQVWG (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQVWG

SEQ ID NO: 331686 - protein, 21 aa, Artificial Sequence
  Description of Artificial Sequence: Synthetic peptide
  Seed: LPDGQVIWVNNTIINGSQVWG (PMEL_HUMAN)
  Core: WVNNTIING
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIXVNXTXINXSQVWG

SEQ ID NO: 331687 - protein, 22 aa, Artificial Sequence
  Description of Artificial Sequence: Synthetic peptide
  Seed: LPDGQVIWVNNTIINGSQVWGG (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQVWGG

SEQ ID NO: 331688 - protein, 22 aa, Artificial Sequence
  Description of Artificial Sequence: Synthetic peptide
  Seed: LPDGQVIWVNNTIINGSQVWGG (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQVWGG

SEQ ID NO: 331689 - protein, 22 aa, Artificial Sequence
  Description of Artificial Sequence: Synthetic peptide
  Seed: LPDGQVIWVNNTIINGSQVWGG (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQVWGG

SEQ ID NO: 331690 - protein, 22 aa, Artificial Sequence
  Description of Artificial Sequence: Synthetic peptide
  Seed: LPDGQVIWVNNTIINGSQVWGG (PMEL_HUMAN)
  Core: WVNNTIING
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIXVNXTXINXSQVWGG

SEQ ID NO: 331691 - protein, 22 aa, Artificial Sequence
  Description of Artificial Sequence: Synthetic peptide
  Seed: LPDGQVIWVNNTIINGSQVWGG (PMEL_HUMAN)
  Core: VNNTIINGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWXNNXIXNGXQVWGG

SEQ ID NO: 331692 - protein, 22 aa, Artificial Sequence
  Description of Artificial Sequence: Synthetic peptide
  Seed: LPDGQVIWVNNTIINGSQVWGG (PMEL_HUMAN)
  Core: INGSQVWGG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWVNNTIXNGXQXWGX

SEQ ID NO: 331693 - protein, 23 aa, Artificial Sequence
  Description of Artificial Sequence: Synthetic peptide
  Seed: LPDGQVIWVNNTIINGSQVWGGQ (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQVWGGQ

SEQ ID NO: 331694 - protein, 23 aa, Artificial Sequence
  Description of Artificial Sequence: Synthetic peptide
  Seed: LPDGQVIWVNNTIINGSQVWGGQ (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQVWGGQ

SEQ ID NO: 331695 - protein, 23 aa, Artificial Sequence
  Description of Artificial Sequence: Synthetic peptide
  Seed: LPDGQVIWVNNTIINGSQVWGGQ (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQVWGGQ

SEQ ID NO: 331696 - protein, 23 aa, Artificial Sequence
  Description of Artificial Sequence: Synthetic peptide
  Seed: LPDGQVIWVNNTIINGSQVWGGQ (PMEL_HUMAN)
  Core: WVNNTIING
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIXVNXTXINXSQVWGGQ

SEQ ID NO: 331697 - protein, 23 aa, Artificial Sequence
  Description of Artificial Sequence: Synthetic peptide
  Seed: LPDGQVIWVNNTIINGSQVWGGQ (PMEL_HUMAN)
  Core: INGSQVWGG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWVNNTIXNGXQXWGXQ

SEQ ID NO: 331698 - protein, 24 aa, Artificial Sequence
  Description of Artificial Sequence: Synthetic peptide
  Seed: LPDGQVIWVNNTIINGSQVWGGQP (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQVWGGQP

SEQ ID NO: 331699 - protein, 24 aa, Artificial Sequence
  Description of Artificial Sequence: Synthetic peptide
  Seed: LPDGQVIWVNNTIINGSQVWGGQP (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQVWGGQP

SEQ ID NO: 331700 - protein, 24 aa, Artificial Sequence
  Description of Artificial Sequence: Synthetic peptide
  Seed: LPDGQVIWVNNTIINGSQVWGGQP (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQVWGGQP

SEQ ID NO: 331701 - protein, 24 aa, Artificial Sequence
  Description of Artificial Sequence: Synthetic peptide
  Seed: LPDGQVIWVNNTIINGSQVWGGQP (PMEL_HUMAN)
  Core: WVNNTIING
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIXVNXTXINXSQVWGGQP

SEQ ID NO: 331702 - protein, 24 aa, Artificial Sequence
  Description of Artificial Sequence: Synthetic peptide
  Seed: LPDGQVIWVNNTIINGSQVWGGQP (PMEL_HUMAN)
  Core: INGSQVWGG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWVNNTIXNGXQXWGXQP

SEQ ID NO: 331703 - protein, 25 aa, Artificial Sequence
  Description of Artificial Sequence: Synthetic peptide
  Seed: LPDGQVIWVNNTIINGSQVWGGQPV (PMEL_HUMAN)
  Core: QVIWVNNTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPDGXVIXVXNTXINGSQVWGGQPV

SEQ ID NO: 331704 - protein, 25 aa, Artificial Sequence
  Description of Artificial Sequence: Synthetic peptide
  Seed: LPDGQVIWVNNTIINGSQVWGGQPV (PMEL_HUMAN)
  Core: VIWVNNTII
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQXIWXNXTIXNGSQVWGGQPV

SEQ ID NO: 331705 - protein, 25 aa, Artificial Sequence
  Description of Artificial Sequence: Synthetic peptide
  Seed: LPDGQVIWVNNTIINGSQVWGGQPV (PMEL_HUMAN)
  Core: IWVNNTIIN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVXWVXNXIIXGSQVWGGQPV

SEQ ID NO: 331706 - protein, 25 aa, Artificial Sequence
  Description of Artificial Sequence: Synthetic peptide
  Seed: LPDGQVIWVNNTIINGSQVWGGQPV (PMEL_HUMAN)
  Core: WVNNTIING
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIXVNXTXINXSQVWGGQPV

SEQ ID NO: 331707 - protein, 25 aa, Artificial Sequence
  Description of Artificial Sequence: Synthetic peptide
  Seed: LPDGQVIWVNNTIINGSQVWGGQPV (PMEL_HUMAN)
  Core: INGSQVWGG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LPDGQVIWVNNTIXNGXQXWGXQPV

SEQ ID NO: 331708 - protein, 14 aa, Artificial Sequence
  Description of Artificial Sequence: Synthetic peptide
  Seed: LPHSSSHWLRLPRI (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRI

SEQ ID NO: 331709 - protein, 15 aa, Artificial Sequence
  Description of Artificial Sequence: Synthetic peptide
  Seed: LPHSSSHWLRLPRIF (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIF

SEQ ID NO: 331710 - protein, 15 aa, Artificial Sequence
  Description of Artificial Sequence: Synthetic peptide
  Seed: LPHSSSHWLRLPRIF (PMEL_HUMAN)
  Core: SSHWLRLPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPHSXSHXLXLPXIF

SEQ ID NO: 331711 - protein, 15 aa, Artificial Sequence
  Description of Artificial Sequence: Synthetic peptide
  Seed: LPHSSSHWLRLPRIF (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXF

SEQ ID NO: 331712 - protein, 16 aa, Artificial Sequence
  Description of Artificial Sequence: Synthetic peptide
  Seed: LPHSSSHWLRLPRIFC (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFC

SEQ ID NO: 331713 - protein, 16 aa, Artificial Sequence
  Description of Artificial Sequence: Synthetic peptide
  Seed: LPHSSSHWLRLPRIFC (PMEL_HUMAN)
  Core: SSHWLRLPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPHSXSHXLXLPXIFC

SEQ ID NO: 331714 - protein, 16 aa, Artificial Sequence
  Description of Artificial Sequence: Synthetic peptide
  Seed: LPHSSSHWLRLPRIFC (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFC

SEQ ID NO: 331715 - protein, 16 aa, Artificial Sequence
  Description of Artificial Sequence: Synthetic peptide
  Seed: LPHSSSHWLRLPRIFC (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFX

SEQ ID NO: 331716 - protein, 17 aa, Artificial Sequence
  Description of Artificial Sequence: Synthetic peptide
  Seed: LPHSSSHWLRLPRIFCS (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCS

SEQ ID NO: 331717 - protein, 17 aa, Artificial Sequence
  Description of Artificial Sequence: Synthetic peptide
  Seed: LPHSSSHWLRLPRIFCS (PMEL_HUMAN)
  Core: SSHWLRLPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPHSXSHXLXLPXIFCS

SEQ ID NO: 331718 - protein, 17 aa, Artificial Sequence
  Description of Artificial Sequence: Synthetic peptide
  Seed: LPHSSSHWLRLPRIFCS (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCS

SEQ ID NO: 331719 - protein, 17 aa, Artificial Sequence
  Description of Artificial Sequence: Synthetic peptide
  Seed: LPHSSSHWLRLPRIFCS (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXS

SEQ ID NO: 331720 - protein, 18 aa, Artificial Sequence
  Description of Artificial Sequence: Synthetic peptide
  Seed: LPHSSSHWLRLPRIFCSC (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSC

SEQ ID NO: 331721 - protein, 19 aa, Artificial Sequence
  Description of Artificial Sequence: Synthetic peptide
  Seed: LPHSSSHWLRLPRIFCSCP (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCP

SEQ ID NO: 331722 - protein, 19 aa, Artificial Sequence
  Description of Artificial Sequence: Synthetic peptide
  Seed: LPHSSSHWLRLPRIFCSCP (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCP

SEQ ID NO: 331723 - protein, 19 aa, Artificial Sequence
  Description of Artificial Sequence: Synthetic peptide
  Seed: LPHSSSHWLRLPRIFCSCP (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCP

SEQ ID NO: 331724 - protein, 20 aa, Artificial Sequence
  Description of Artificial Sequence: Synthetic peptide
  Seed: LPHSSSHWLRLPRIFCSCPI (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCPI

SEQ ID NO: 331725 - protein, 20 aa, Artificial Sequence
  Description of Artificial Sequence: Synthetic peptide
  Seed: LPHSSSHWLRLPRIFCSCPI (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCPI

SEQ ID NO: 331726 - protein, 20 aa, Artificial Sequence
  Description of Artificial Sequence: Synthetic peptide
  Seed: LPHSSSHWLRLPRIFCSCPI (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCPI

SEQ ID NO: 331727 - protein, 20 aa, Artificial Sequence
  Description of Artificial Sequence: Synthetic peptide
  Seed: LPHSSSHWLRLPRIFCSCPI (PMEL_HUMAN)
  Core: PRIFCSCPI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLXRIXCXCPX

SEQ ID NO: 331728 - protein, 21 aa, Artificial Sequence
  Description of Artificial Sequence: Synthetic peptide
  Seed: LPHSSSHWLRLPRIFCSCPIG (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCPIG

SEQ ID NO: 331729 - protein, 21 aa, Artificial Sequence
  Description of Artificial Sequence: Synthetic peptide
  Seed: LPHSSSHWLRLPRIFCSCPIG (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCPIG

SEQ ID NO: 331730 - protein, 21 aa, Artificial Sequence
  Description of Artificial Sequence: Synthetic peptide
  Seed: LPHSSSHWLRLPRIFCSCPIG (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCPIG

SEQ ID NO: 331731 - protein, 21 aa, Artificial Sequence
  Description of Artificial Sequence: Synthetic peptide
  Seed: LPHSSSHWLRLPRIFCSCPIG (PMEL_HUMAN)
  Core: PRIFCSCPI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLXRIXCXCPXG

SEQ ID NO: 331732 - protein, 22 aa, Artificial Sequence
  Description of Artificial Sequence: Synthetic peptide
  Seed: LPHSSSHWLRLPRIFCSCPIGE (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCPIGE

SEQ ID NO: 331733 - protein, 22 aa, Artificial Sequence
  Description of Artificial Sequence: Synthetic peptide
  Seed: LPHSSSHWLRLPRIFCSCPIGE (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCPIGE

SEQ ID NO: 331734 - protein, 22 aa, Artificial Sequence
  Description of Artificial Sequence: Synthetic peptide
  Seed: LPHSSSHWLRLPRIFCSCPIGE (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCPIGE

SEQ ID NO: 331735 - protein, 22 aa, Artificial Sequence
  Description of Artificial Sequence: Synthetic peptide
  Seed: LPHSSSHWLRLPRIFCSCPIGE (PMEL_HUMAN)
  Core: PRIFCSCPI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLXRIXCXCPXGE

SEQ ID NO: 331736 - protein, 23 aa, Artificial Sequence
  Description of Artificial Sequence: Synthetic peptide
  Seed: LPHSSSHWLRLPRIFCSCPIGEN (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCPIGEN

SEQ ID NO: 331737 - protein, 23 aa, Artificial Sequence
  Description of Artificial Sequence: Synthetic peptide
  Seed: LPHSSSHWLRLPRIFCSCPIGEN (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCPIGEN

SEQ ID NO: 331738 - protein, 23 aa, Artificial Sequence
  Description of Artificial Sequence: Synthetic peptide
  Seed: LPHSSSHWLRLPRIFCSCPIGEN (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCPIGEN

SEQ ID NO: 331739 - protein, 23 aa, Artificial Sequence
  Description of Artificial Sequence: Synthetic peptide
  Seed: LPHSSSHWLRLPRIFCSCPIGEN (PMEL_HUMAN)
  Core: PRIFCSCPI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLXRIXCXCPXGEN

SEQ ID NO: 331740 - protein, 23 aa, Artificial Sequence
  Description of Artificial Sequence: Synthetic peptide
  Seed: LPHSSSHWLRLPRIFCSCPIGEN (PMEL_HUMAN)
  Core: RIFCSCPIG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPXIFXSXPIXEN

SEQ ID NO: 331741 - protein, 24 aa, Artificial Sequence
  Description of Artificial Sequence: Synthetic peptide
  Seed: LPHSSSHWLRLPRIFCSCPIGENS (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCPIGENS

SEQ ID NO: 331742 - protein, 24 aa, Artificial Sequence
  Description of Artificial Sequence: Synthetic peptide
  Seed: LPHSSSHWLRLPRIFCSCPIGENS (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCPIGENS

SEQ ID NO: 331743 - protein, 24 aa, Artificial Sequence
  Description of Artificial Sequence: Synthetic peptide
  Seed: LPHSSSHWLRLPRIFCSCPIGENS (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCPIGENS

SEQ ID NO: 331744 - protein, 24 aa, Artificial Sequence
  Description of Artificial Sequence: Synthetic peptide
  Seed: LPHSSSHWLRLPRIFCSCPIGENS (PMEL_HUMAN)
  Core: PRIFCSCPI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLXRIXCXCPXGENS

SEQ ID NO: 331745 - protein, 24 aa, Artificial Sequence
  Description of Artificial Sequence: Synthetic peptide
  Seed: LPHSSSHWLRLPRIFCSCPIGENS (PMEL_HUMAN)
  Core: RIFCSCPIG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPXIFXSXPIXENS

SEQ ID NO: 331746 - protein, 24 aa, Artificial Sequence
  Description of Artificial Sequence: Synthetic peptide
  Seed: LPHSSSHWLRLPRIFCSCPIGENS (PMEL_HUMAN)
  Core: IFCSCPIGE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPRXFCXCXIGXNS

SEQ ID NO: 331747 - protein, 24 aa, Artificial Sequence
  Description of Artificial Sequence: Synthetic peptide
  Seed: LPHSSSHWLRLPRIFCSCPIGENS (PMEL_HUMAN)
  Core: FCSCPIGEN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPRIXCSXPXGEXS

SEQ ID NO: 331748 - protein, 25 aa, Artificial Sequence
  Description of Artificial Sequence: Synthetic peptide
  Seed: LPHSSSHWLRLPRIFCSCPIGENSP (PMEL_HUMAN)
  Core: HSSSHWLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LPXSSXHXLRXPRIFCSCPIGENSP

SEQ ID NO: 331749 - protein, 25 aa, Artificial Sequence
  Description of Artificial Sequence: Synthetic peptide
  Seed: LPHSSSHWLRLPRIFCSCPIGENSP (PMEL_HUMAN)
  Core: SHWLRLPRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSXHWXRXPRXFCSCPIGENSP

SEQ ID NO: 331750 - protein, 25 aa, Artificial Sequence
  Description of Artificial Sequence: Synthetic peptide
  Seed: LPHSSSHWLRLPRIFCSCPIGENSP (PMEL_HUMAN)
  Core: WLRLPRIFC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHXLRXPXIFXSCPIGENSP

SEQ ID NO: 331751 - protein, 25 aa, Artificial Sequence
  Description of Artificial Sequence: Synthetic peptide
  Seed: LPHSSSHWLRLPRIFCSCPIGENSP (PMEL_HUMAN)
  Core: PRIFCSCPI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLXRIXCXCPXGENSP

SEQ ID NO: 331752 - protein, 25 aa, Artificial Sequence
  Description of Artificial Sequence: Synthetic peptide
  Seed: LPHSSSHWLRLPRIFCSCPIGENSP (PMEL_HUMAN)
  Core: RIFCSCPIG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPXIFXSXPIXENSP

SEQ ID NO: 331753 - protein, 25 aa, Artificial Sequence
  Description of Artificial Sequence: Synthetic peptide
  Seed: LPHSSSHWLRLPRIFCSCPIGENSP (PMEL_HUMAN)
  Core: IFCSCPIGE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPRXFCXCXIGXNSP

SEQ ID NO: 331754 - protein, 25 aa, Artificial Sequence
  Description of Artificial Sequence: Synthetic peptide
  Seed: LPHSSSHWLRLPRIFCSCPIGENSP (PMEL_HUMAN)
  Core: FCSCPIGEN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LPHSSSHWLRLPRIXCSXPXGEXSP

SEQ ID NO: 331755 - protein, 17 aa, Artificial Sequence
  Description of Artificial Sequence: Synthetic peptide
  Seed: LPIPEPEGPDASSIMST (PMEL_HUMAN)
  Core: PEGPDASSI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEXEGXDXSSXMST

SEQ ID NO: 331756 - protein, 19 aa, Artificial Sequence
  Description of Artificial Sequence: Synthetic peptide
  Seed: LPIPEPEGPDASSIMSTES (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXES

SEQ ID NO: 331757 - protein, 20 aa, Artificial Sequence
  Description of Artificial Sequence: Synthetic peptide
  Seed: LPIPEPEGPDASSIMSTESI (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXESI

SEQ ID NO: 331758 - protein, 21 aa, Artificial Sequence
  Description of Artificial Sequence: Synthetic peptide
  Seed: LPIPEPEGPDASSIMSTESIT (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXESIT

SEQ ID NO: 331759 - protein, 22 aa, Artificial Sequence
  Description of Artificial Sequence: Synthetic peptide
  Seed: LPIPEPEGPDASSIMSTESITG (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXESITG

SEQ ID NO: 331760 - protein, 23 aa, Artificial Sequence
  Description of Artificial Sequence: Synthetic peptide
  Seed: LPIPEPEGPDASSIMSTESITGS (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXESITGS

SEQ ID NO: 331761 - protein, 24 aa, Artificial Sequence
  Description of Artificial Sequence: Synthetic peptide
  Seed: LPIPEPEGPDASSIMSTESITGSL (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXESITGSL

SEQ ID NO: 331762 - protein, 25 aa, Artificial Sequence
  Description of Artificial Sequence: Synthetic peptide
  Seed: LPIPEPEGPDASSIMSTESITGSLG (PMEL_HUMAN)
  Core: PDASSIMST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LPIPEPEGXDAXSXMSXESITGSLG

SEQ ID NO: 331763 - protein, 15 aa, Artificial Sequence
  Description of Artificial Sequence: Synthetic peptide
  Seed: LPRIFCSCPIGENSP (PMEL_HUMAN)
  Core: IFCSCPIGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LPRXFCXCXIGXNSP

SEQ ID NO: 331764 - protein, 15 aa, Artificial Sequence
  Description of Artificial Sequence: Synthetic peptide
  Seed: LPRIFCSCPIGENSP (PMEL_HUMAN)
  Core: FCSCPIGEN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPRIXCSXPXGEXSP

SEQ ID NO: 331765 - protein, 20 aa, Artificial Sequence
  Description of Artificial Sequence: Synthetic peptide
  Seed: LPRIFCSCPIGENSPLLSGQ (PMEL_HUMAN)
  Core: IGENSPLLS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPRIFCSCPXGEXSXLLXGQ

SEQ ID NO: 331766 - protein, 14 aa, Artificial Sequence
  Description of Artificial Sequence: Synthetic peptide
  Seed: LPSPACQLVLHQIL (PMEL_HUMAN)
  Core: ACQLVLHQI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPSPXCQXVXHQXL

SEQ ID NO: 331767 - protein, 14 aa, Artificial Sequence
  Description of Artificial Sequence: Synthetic peptide
  Seed: LPSPACQLVLHQIL (PMEL_HUMAN)
  Core: CQLVLHQIL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPSPAXQLXLXQIX

SEQ ID NO: 331768 - protein, 15 aa, Artificial Sequence
  Description of Artificial Sequence: Synthetic peptide
  Seed: LPSPACQLVLHQILK (PMEL_HUMAN)
  Core: PACQLVLHQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LPSXACXLXLHXILK

SEQ ID NO: 331769 - protein, 15 aa, Artificial Sequence
  Description of Artificial Sequence: Synthetic peptide
  Seed: LPSPACQLVLHQILK (PMEL_HUMAN)
  Core: ACQLVLHQI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPSPXCQXVXHQXLK

SEQ ID NO: 331770 - protein, 15 aa, Artificial Sequence
  Description of Artificial Sequence: Synthetic peptide
  Seed: LPSPACQLVLHQILK (PMEL_HUMAN)
  Core: CQLVLHQIL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPSPAXQLXLXQIXK

SEQ ID NO: 331771 - protein, 16 aa, Artificial Sequence
  Description of Artificial Sequence: Synthetic peptide
  Seed: LPSPACQLVLHQILKG (PMEL_HUMAN)
  Core: PACQLVLHQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LPSXACXLXLHXILKG

SEQ ID NO: 331772 - protein, 16 aa, Artificial Sequence
  Description of Artificial Sequence: Synthetic peptide
  Seed: LPSPACQLVLHQILKG (PMEL_HUMAN)
  Core: ACQLVLHQI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LPSPXCQXVXHQXLKG

SEQ ID NO: 331773 - protein, 16 aa, Artificial Sequence
  Description of Artificial Sequence: Synthetic peptide
  Seed: LPSPACQLVLHQILKG (PMEL_HUMAN)
  Core: CQLVLHQIL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPSPAXQLXLXQIXKG

SEQ ID NO: 331774 - protein, 16 aa, Artificial Sequence
  Description of Artificial Sequence: Synthetic peptide
  Seed: LPSPACQLVLHQILKG (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKX

SEQ ID NO: 331775 - protein, 17 aa, Artificial Sequence
  Description of Artificial Sequence: Synthetic peptide
  Seed: LPSPACQLVLHQILKGG (PMEL_HUMAN)
  Core: CQLVLHQIL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LPSPAXQLXLXQIXKGG

SEQ ID NO: 331776 - protein, 17 aa, Artificial Sequence
  Description of Artificial Sequence: Synthetic peptide
  Seed: LPSPACQLVLHQILKGG (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXG

SEQ ID NO: 331777 - protein, 18 aa, Artificial Sequence
  Description of Artificial Sequence: Synthetic peptide
  Seed: LPSPACQLVLHQILKGGS (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGS

SEQ ID NO: 331778 - protein, 19 aa, Artificial Sequence
  Description of Artificial Sequence: Synthetic peptide
  Seed: LPSPACQLVLHQILKGGSG (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSG

SEQ ID NO: 331779 - protein, 19 aa, Artificial Sequence
  Description of Artificial Sequence: Synthetic peptide
  Seed: LPSPACQLVLHQILKGGSG (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXG

SEQ ID NO: 331780 - protein, 20 aa, Artificial Sequence
  Description of Artificial Sequence: Synthetic peptide
  Seed: LPSPACQLVLHQILKGGSGT (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSGT

SEQ ID NO: 331781 - protein, 20 aa, Artificial Sequence
  Description of Artificial Sequence: Synthetic peptide
  Seed: LPSPACQLVLHQILKGGSGT (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXGT

SEQ ID NO: 331782 - protein, 21 aa, Artificial Sequence
  Description of Artificial Sequence: Synthetic peptide
  Seed: LPSPACQLVLHQILKGGSGTY (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSGTY

SEQ ID NO: 331783 - protein, 21 aa, Artificial Sequence
  Description of Artificial Sequence: Synthetic peptide
  Seed: LPSPACQLVLHQILKGGSGTY (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXGTY

SEQ ID NO: 331784 - protein, 22 aa, Artificial Sequence
  Description of Artificial Sequence: Synthetic peptide
  Seed: LPSPACQLVLHQILKGGSGTYC (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSGTYC

SEQ ID NO: 331785 - protein, 22 aa, Artificial Sequence
  Description of Artificial Sequence: Synthetic peptide
  Seed: LPSPACQLVLHQILKGGSGTYC (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXGTYC

SEQ ID NO: 331786 - protein, 23 aa, Artificial Sequence
  Description of Artificial Sequence: Synthetic peptide
  Seed: LPSPACQLVLHQILKGGSGTYCL (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSGTYCL

SEQ ID NO: 331787 - protein, 23 aa, Artificial Sequence
  Description of Artificial Sequence: Synthetic peptide
  Seed: LPSPACQLVLHQILKGGSGTYCL (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXGTYCL

SEQ ID NO: 331788 - protein, 24 aa, Artificial Sequence
  Description of Artificial Sequence: Synthetic peptide
  Seed: LPSPACQLVLHQILKGGSGTYCLN (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSGTYCLN

SEQ ID NO: 331789 - protein, 24 aa, Artificial Sequence
  Description of Artificial Sequence: Synthetic peptide
  Seed: LPSPACQLVLHQILKGGSGTYCLN (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXGTYCLN

SEQ ID NO: 331790 - protein, 25 aa, Artificial Sequence
  Description of Artificial Sequence: Synthetic peptide
  Seed: LPSPACQLVLHQILKGGSGTYCLNV (PMEL_HUMAN)
  Core: LVLHQILKG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQXVLXQXLKXGSGTYCLNV

SEQ ID NO: 331791 - protein, 25 aa, Artificial Sequence
  Description of Artificial Sequence: Synthetic peptide
  Seed: LPSPACQLVLHQILKGGSGTYCLNV (PMEL_HUMAN)
  Core: LHQILKGGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LPSPACQLVXHQXLXGGXGTYCLNV

SEQ ID NO: 331792 - protein, 13 aa, Artificial Sequence
  Description of Artificial Sequence: Synthetic peptide
  Seed: LQAAIPLTSCGSS (PMEL_HUMAN)
  Core: LQAAIPLTS
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XQAXIXLTXCGSS

SEQ ID NO: 331793 - protein, 14 aa, Artificial Sequence
  Description of Artificial Sequence: Synthetic peptide
  Seed: LQAAIPLTSCGSSP (PMEL_HUMAN)
  Core: LQAAIPLTS
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XQAXIXLTXCGSSP

SEQ ID NO: 331794 - protein, 14 aa, Artificial Sequence
  Description of Artificial Sequence: Synthetic peptide
  Seed: LQAAIPLTSCGSSP (PMEL_HUMAN)
  Core: AIPLTSCGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LQAXIPXTXCGXSP

SEQ ID NO: 331795 - protein, 15 aa, Artificial Sequence
  Description of Artificial Sequence: Synthetic peptide
  Seed: LQAAIPLTSCGSSPV (PMEL_HUMAN)
  Core: LQAAIPLTS
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XQAXIXLTXCGSSPV

SEQ ID NO: 331796 - protein, 15 aa, Artificial Sequence
  Description of Artificial Sequence: Synthetic peptide
  Seed: LQAAIPLTSCGSSPV (PMEL_HUMAN)
  Core: AIPLTSCGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LQAXIPXTXCGXSPV

SEQ ID NO: 331797 - protein, 15 aa, Artificial Sequence
  Description of Artificial Sequence: Synthetic peptide
  Seed: LQAAIPLTSCGSSPV (PMEL_HUMAN)
  Core: LTSCGSSPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPXTSXGXSPX

SEQ ID NO: 331798 - protein, 16 aa, Artificial Sequence
  Description of Artificial Sequence: Synthetic peptide
  Seed: LQAAIPLTSCGSSPVP (PMEL_HUMAN)
  Core: LTSCGSSPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPXTSXGXSPXP

SEQ ID NO: 331799 - protein, 17 aa, Artificial Sequence
  Description of Artificial Sequence: Synthetic peptide
  Seed: LQAAIPLTSCGSSPVPG (PMEL_HUMAN)
  Core: LTSCGSSPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPXTSXGXSPXPG

SEQ ID NO: 331800 - protein, 18 aa, Artificial Sequence
  Description of Artificial Sequence: Synthetic peptide
  Seed: LQAAIPLTSCGSSPVPGT (PMEL_HUMAN)
  Core: LTSCGSSPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPXTSXGXSPXPGT

SEQ ID NO: 331801 - protein, 19 aa, Artificial Sequence
  Description of Artificial Sequence: Synthetic peptide
  Seed: LQAAIPLTSCGSSPVPGTT (PMEL_HUMAN)
  Core: LTSCGSSPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPXTSXGXSPXPGTT

SEQ ID NO: 331802 - protein, 19 aa, Artificial Sequence
  Description of Artificial Sequence: Synthetic peptide
  Seed: LQAAIPLTSCGSSPVPGTT (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTT

SEQ ID NO: 331803 - protein, 20 aa, Artificial Sequence
  Description of Artificial Sequence: Synthetic peptide
  Seed: LQAAIPLTSCGSSPVPGTTD (PMEL_HUMAN)
  Core: LTSCGSSPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPXTSXGXSPXPGTTD

SEQ ID NO: 331804 - protein, 20 aa, Artificial Sequence
  Description of Artificial Sequence: Synthetic peptide
  Seed: LQAAIPLTSCGSSPVPGTTD (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTTD

SEQ ID NO: 331805 - protein, 21 aa, Artificial Sequence
  Description of Artificial Sequence: Synthetic peptide
  Seed: LQAAIPLTSCGSSPVPGTTDG (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTTDG

SEQ ID NO: 331806 - protein, 22 aa, Artificial Sequence
  Description of Artificial Sequence: Synthetic peptide
  Seed: LQAAIPLTSCGSSPVPGTTDGH (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTTDGH

SEQ ID NO: 331807 - protein, 23 aa, Artificial Sequence
  Description of Artificial Sequence: Synthetic peptide
  Seed: LQAAIPLTSCGSSPVPGTTDGHR (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTTDGHR

SEQ ID NO: 331808 - protein, 24 aa, Artificial Sequence
  Description of Artificial Sequence: Synthetic peptide
  Seed: LQAAIPLTSCGSSPVPGTTDGHRP (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTTDGHRP

SEQ ID NO: 331809 - protein, 24 aa, Artificial Sequence
  Description of Artificial Sequence: Synthetic peptide
  Seed: LQAAIPLTSCGSSPVPGTTDGHRP (PMEL_HUMAN)
  Core: PVPGTTDGH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTSCGSSXVPXTXDGXRP

SEQ ID NO: 331810 - protein, 25 aa, Artificial Sequence
  Description of Artificial Sequence: Synthetic peptide
  Seed: LQAAIPLTSCGSSPVPGTTDGHRPT (PMEL_HUMAN)
  Core: SCGSSPVPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTXCGXSXVPXTTDGHRPT

SEQ ID NO: 331811 - protein, 25 aa, Artificial Sequence
  Description of Artificial Sequence: Synthetic peptide
  Seed: LQAAIPLTSCGSSPVPGTTDGHRPT (PMEL_HUMAN)
  Core: PVPGTTDGH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LQAAIPLTSCGSSXVPXTXDGXRPT

SEQ ID NO: 331812 - protein, 19 aa, Artificial Sequence
  Description of Artificial Sequence: Synthetic peptide
  Seed: LQLHDPSGYLAEADLSYTW (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTW

SEQ ID NO: 331813 - protein, 19 aa, Artificial Sequence
  Description of Artificial Sequence: Synthetic peptide
  Seed: LQLHDPSGYLAEADLSYTW (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTW

SEQ ID NO: 331814 - protein, 20 aa, Artificial Sequence
  Description of Artificial Sequence: Synthetic peptide
  Seed: LQLHDPSGYLAEADLSYTWD (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTWD

SEQ ID NO: 331815 - protein, 20 aa, Artificial Sequence
  Description of Artificial Sequence: Synthetic peptide
  Seed: LQLHDPSGYLAEADLSYTWD (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTWD

SEQ ID NO: 331816 - protein, 21 aa, Artificial Sequence
  Description of Artificial Sequence: Synthetic peptide
  Seed: LQLHDPSGYLAEADLSYTWDF (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTWDF

SEQ ID NO: 331817 - protein, 21 aa, Artificial Sequence
  Description of Artificial Sequence: Synthetic peptide
  Seed: LQLHDPSGYLAEADLSYTWDF (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTWDF

SEQ ID NO: 331818 - protein, 22 aa, Artificial Sequence
  Description of Artificial Sequence: Synthetic peptide
  Seed: LQLHDPSGYLAEADLSYTWDFG (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTWDFG

SEQ ID NO: 331819 - protein, 22 aa, Artificial Sequence
  Description of Artificial Sequence: Synthetic peptide
  Seed: LQLHDPSGYLAEADLSYTWDFG (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTWDFG

SEQ ID NO: 331820 - protein, 23 aa, Artificial Sequence
  Description of Artificial Sequence: Synthetic peptide
  Seed: LQLHDPSGYLAEADLSYTWDFGD (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTWDFGD

SEQ ID NO: 331821 - protein, 23 aa, Artificial Sequence
  Description of Artificial Sequence: Synthetic peptide
  Seed: LQLHDPSGYLAEADLSYTWDFGD (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTWDFGD

SEQ ID NO: 331822 - protein, 24 aa, Artificial Sequence
  Description of Artificial Sequence: Synthetic peptide
  Seed: LQLHDPSGYLAEADLSYTWDFGDS (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTWDFGDS

SEQ ID NO: 331823 - protein, 24 aa, Artificial Sequence
  Description of Artificial Sequence: Synthetic peptide
  Seed: LQLHDPSGYLAEADLSYTWDFGDS (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTWDFGDS

SEQ ID NO: 331824 - protein, 24 aa, Artificial Sequence
  Description of Artificial Sequence: Synthetic peptide
  Seed: LQLHDPSGYLAEADLSYTWDFGDS (PMEL_HUMAN)
  Core: LSYTWDFGD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGYLAEADXSYXWXFGXS

SEQ ID NO: 331825 - protein, 25 aa, Artificial Sequence
  Description of Artificial Sequence: Synthetic peptide
  Seed: LQLHDPSGYLAEADLSYTWDFGDSS (PMEL_HUMAN)
  Core: PSGYLAEAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDXSGXLXEAXLSYTWDFGDSS

SEQ ID NO: 331826 - protein, 25 aa, Artificial Sequence
  Description of Artificial Sequence: Synthetic peptide
  Seed: LQLHDPSGYLAEADLSYTWDFGDSS (PMEL_HUMAN)
  Core: YLAEADLSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGXLAXAXLSXTWDFGDSS

SEQ ID NO: 331827 - protein, 25 aa, Artificial Sequence
  Description of Artificial Sequence: Synthetic peptide
  Seed: LQLHDPSGYLAEADLSYTWDFGDSS (PMEL_HUMAN)
  Core: LSYTWDFGD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LQLHDPSGYLAEADXSYXWXFGXSS

SEQ ID NO: 331828 - protein, 19 aa, Artificial Sequence
  Description of Artificial Sequence: Synthetic peptide
  Seed: LRALDGGNKHFLRNQPLTF (PMEL_HUMAN)
  Core: LDGGNKHFL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRAXDGXNXHFXRNQPLTF

SEQ ID NO: 331829 - protein, 19 aa, Artificial Sequence
  Description of Artificial Sequence: Synthetic peptide
  Seed: LRALDGGNKHFLRNQPLTF (PMEL_HUMAN)
  Core: GGNKHFLRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRALDXGNXHXLRXQPLTF

SEQ ID NO: 331830 - protein, 19 aa, Artificial Sequence
  Description of Artificial Sequence: Synthetic peptide
  Seed: LRALDGGNKHFLRNQPLTF (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTF

SEQ ID NO: 331831 - protein, 19 aa, Artificial Sequence
  Description of Artificial Sequence: Synthetic peptide
  Seed: LRALDGGNKHFLRNQPLTF (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTX

SEQ ID NO: 331832 - protein, 20 aa, Artificial Sequence
  Description of Artificial Sequence: Synthetic peptide
  Seed: LRALDGGNKHFLRNQPLTFA (PMEL_HUMAN)
  Core: LDGGNKHFL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRAXDGXNXHFXRNQPLTFA

SEQ ID NO: 331833 - protein, 20 aa, Artificial Sequence
  Description of Artificial Sequence: Synthetic peptide
  Seed: LRALDGGNKHFLRNQPLTFA (PMEL_HUMAN)
  Core: GGNKHFLRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRALDXGNXHXLRXQPLTFA

SEQ ID NO: 331834 - protein, 20 aa, Artificial Sequence
  Description of Artificial Sequence: Synthetic peptide
  Seed: LRALDGGNKHFLRNQPLTFA (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTFA

SEQ ID NO: 331835 - protein, 20 aa, Artificial Sequence
  Description of Artificial Sequence: Synthetic peptide
  Seed: LRALDGGNKHFLRNQPLTFA (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTXA

SEQ ID NO: 331836 - protein, 21 aa, Artificial Sequence
  Description of Artificial Sequence: Synthetic peptide
  Seed: LRALDGGNKHFLRNQPLTFAL (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTFAL

SEQ ID NO: 331837 - protein, 21 aa, Artificial Sequence
  Description of Artificial Sequence: Synthetic peptide
  Seed: LRALDGGNKHFLRNQPLTFAL (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTXAL

SEQ ID NO: 331838 - protein, 21 aa, Artificial Sequence
  Description of Artificial Sequence: Synthetic peptide
  Seed: LRALDGGNKHFLRNQPLTFAL (PMEL_HUMAN)
  Core: LRNQPLTFA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFXRNXPXTFXL

SEQ ID NO: 331839 - protein, 22 aa, Artificial Sequence
  Description of Artificial Sequence: Synthetic peptide
  Seed: LRALDGGNKHFLRNQPLTFALQ (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTFALQ

SEQ ID NO: 331840 - protein, 22 aa, Artificial Sequence
  Description of Artificial Sequence: Synthetic peptide
  Seed: LRALDGGNKHFLRNQPLTFALQ (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTXALQ

SEQ ID NO: 331841 - protein, 22 aa, Artificial Sequence
  Description of Artificial Sequence: Synthetic peptide
  Seed: LRALDGGNKHFLRNQPLTFALQ (PMEL_HUMAN)
  Core: LRNQPLTFA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFXRNXPXTFXLQ

SEQ ID NO: 331842 - protein, 23 aa, Artificial Sequence
  Description of Artificial Sequence: Synthetic peptide
  Seed: LRALDGGNKHFLRNQPLTFALQL (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTFALQL

SEQ ID NO: 331843 - protein, 23 aa, Artificial Sequence
  Description of Artificial Sequence: Synthetic peptide
  Seed: LRALDGGNKHFLRNQPLTFALQL (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTXALQL

SEQ ID NO: 331844 - protein, 23 aa, Artificial Sequence
  Description of Artificial Sequence: Synthetic peptide
  Seed: LRALDGGNKHFLRNQPLTFALQL (PMEL_HUMAN)
  Core: LRNQPLTFA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFXRNXPXTFXLQL

SEQ ID NO: 331845 - protein, 24 aa, Artificial Sequence
  Description of Artificial Sequence: Synthetic peptide
  Seed: LRALDGGNKHFLRNQPLTFALQLH (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTFALQLH

SEQ ID NO: 331846 - protein, 24 aa, Artificial Sequence
  Description of Artificial Sequence: Synthetic peptide
  Seed: LRALDGGNKHFLRNQPLTFALQLH (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTXALQLH

SEQ ID NO: 331847 - protein, 24 aa, Artificial Sequence
  Description of Artificial Sequence: Synthetic peptide
  Seed: LRALDGGNKHFLRNQPLTFALQLH (PMEL_HUMAN)
  Core: LRNQPLTFA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFXRNXPXTFXLQLH

SEQ ID NO: 331848 - protein, 24 aa, Artificial Sequence
  Description of Artificial Sequence: Synthetic peptide
  Seed: LRALDGGNKHFLRNQPLTFALQLH (PMEL_HUMAN)
  Core: RNQPLTFAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFLXNQXLXFAXQLH

SEQ ID NO: 331849 - protein, 25 aa, Artificial Sequence
  Description of Artificial Sequence: Synthetic peptide
  Seed: LRALDGGNKHFLRNQPLTFALQLHD (PMEL_HUMAN)
  Core: KHFLRNQPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNXHFXRXQPXTFALQLHD

SEQ ID NO: 331850 - protein, 25 aa, Artificial Sequence
  Description of Artificial Sequence: Synthetic peptide
  Seed: LRALDGGNKHFLRNQPLTFALQLHD (PMEL_HUMAN)
  Core: FLRNQPLTF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHXLRXQXLTXALQLHD

SEQ ID NO: 331851 - protein, 25 aa, Artificial Sequence
  Description of Artificial Sequence: Synthetic peptide
  Seed: LRALDGGNKHFLRNQPLTFALQLHD (PMEL_HUMAN)
  Core: LRNQPLTFA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFXRNXPXTFXLQLHD

SEQ ID NO: 331852 - protein, 25 aa, Artificial Sequence
  Description of Artificial Sequence: Synthetic peptide
  Seed: LRALDGGNKHFLRNQPLTFALQLHD (PMEL_HUMAN)
  Core: RNQPLTFAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFLXNQXLXFAXQLHD

SEQ ID NO: 331853 - protein, 25 aa, Artificial Sequence
  Description of Artificial Sequence: Synthetic peptide
  Seed: LRALDGGNKHFLRNQPLTFALQLHD (PMEL_HUMAN)
  Core: PLTFALQLH
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LRALDGGNKHFLRNQXLTXAXQLXD

SEQ ID NO: 331854 - protein, 14 aa, Artificial Sequence
  Description of Artificial Sequence: Synthetic peptide
  Seed: LRLPRIFCSCPIGE (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGE

SEQ ID NO: 331855 - protein, 15 aa, Artificial Sequence
  Description of Artificial Sequence: Synthetic peptide
  Seed: LRLPRIFCSCPIGEN (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGEN

SEQ ID NO: 331856 - protein, 15 aa, Artificial Sequence
  Description of Artificial Sequence: Synthetic peptide
  Seed: LRLPRIFCSCPIGEN (PMEL_HUMAN)
  Core: RIFCSCPIG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLPXIFXSXPIXEN

SEQ ID NO: 331857 - protein, 15 aa, Artificial Sequence
  Description of Artificial Sequence: Synthetic peptide
  Seed: LRLPRIFCSCPIGEN (PMEL_HUMAN)
  Core: IFCSCPIGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRXFCXCXIGXN

SEQ ID NO: 331858 - protein, 16 aa, Artificial Sequence
  Description of Artificial Sequence: Synthetic peptide
  Seed: LRLPRIFCSCPIGENS (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGENS

SEQ ID NO: 331859 - protein, 16 aa, Artificial Sequence
  Description of Artificial Sequence: Synthetic peptide
  Seed: LRLPRIFCSCPIGENS (PMEL_HUMAN)
  Core: FCSCPIGEN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRIXCSXPXGEXS

SEQ ID NO: 331860 - protein, 17 aa, Artificial Sequence
  Description of Artificial Sequence: Synthetic peptide
  Seed: LRLPRIFCSCPIGENSP (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGENSP

SEQ ID NO: 331861 - protein, 17 aa, Artificial Sequence
  Description of Artificial Sequence: Synthetic peptide
  Seed: LRLPRIFCSCPIGENSP (PMEL_HUMAN)
  Core: FCSCPIGEN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRIXCSXPXGEXSP

SEQ ID NO: 331862 - protein, 19 aa, Artificial Sequence
  Description of Artificial Sequence: Synthetic peptide
  Seed: LRLPRIFCSCPIGENSPLL (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGENSPLL

SEQ ID NO: 331863 - protein, 20 aa, Artificial Sequence
  Description of Artificial Sequence: Synthetic peptide
  Seed: LRLPRIFCSCPIGENSPLLS (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGENSPLLS

SEQ ID NO: 331864 - protein, 20 aa, Artificial Sequence
  Description of Artificial Sequence: Synthetic peptide
  Seed: LRLPRIFCSCPIGENSPLLS (PMEL_HUMAN)
  Core: IFCSCPIGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRXFCXCXIGXNSPLLS

SEQ ID NO: 331865 - protein, 20 aa, Artificial Sequence
  Description of Artificial Sequence: Synthetic peptide
  Seed: LRLPRIFCSCPIGENSPLLS (PMEL_HUMAN)
  Core: FCSCPIGEN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRIXCSXPXGEXSPLLS

SEQ ID NO: 331866 - protein, 21 aa, Artificial Sequence
  Description of Artificial Sequence: Synthetic peptide
  Seed: LRLPRIFCSCPIGENSPLLSG (PMEL_HUMAN)
  Core: PRIFCSCPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXRIXCXCPXGENSPLLSG

SEQ ID NO: 331867 - protein, 22 aa, Artificial Sequence
  Description of Artificial Sequence: Synthetic peptide
  Seed: LRLPRIFCSCPIGENSPLLSGQ (PMEL_HUMAN)
  Core: IGENSPLLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRIFCSCPXGEXSXLLXGQ

SEQ ID NO: 331868 - protein, 23 aa, Artificial Sequence
  Description of Artificial Sequence: Synthetic peptide
  Seed: LRLPRIFCSCPIGENSPLLSGQQ (PMEL_HUMAN)
  Core: IGENSPLLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRIFCSCPXGEXSXLLXGQQ

SEQ ID NO: 331869 - protein, 24 aa, Artificial Sequence
  Description of Artificial Sequence: Synthetic peptide
  Seed: LRLPRIFCSCPIGENSPLLSGQQV (PMEL_HUMAN)
  Core: IGENSPLLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRLPRIFCSCPXGEXSXLLXGQQV

SEQ ID NO: 331870 - protein, 14 aa, Artificial Sequence
  Description of Artificial Sequence: Synthetic peptide
  Seed: LRLVKRQVPLDCVL (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVL

SEQ ID NO: 331871 - protein, 14 aa, Artificial Sequence
  Description of Artificial Sequence: Synthetic peptide
  Seed: LRLVKRQVPLDCVL (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVL

SEQ ID NO: 331872 - protein, 14 aa, Artificial Sequence
  Description of Artificial Sequence: Synthetic peptide
  Seed: LRLVKRQVPLDCVL (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXL

SEQ ID NO: 331873 - protein, 15 aa, Artificial Sequence
  Description of Artificial Sequence: Synthetic peptide
  Seed: LRLVKRQVPLDCVLY (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLY

SEQ ID NO: 331874 - protein, 15 aa, Artificial Sequence
  Description of Artificial Sequence: Synthetic peptide
  Seed: LRLVKRQVPLDCVLY (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLY

SEQ ID NO: 331875 - protein, 15 aa, Artificial Sequence
  Description of Artificial Sequence: Synthetic peptide
  Seed: LRLVKRQVPLDCVLY (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLY

SEQ ID NO: 331876 - protein, 16 aa, Artificial Sequence
  Description of Artificial Sequence: Synthetic peptide
  Seed: LRLVKRQVPLDCVLYR (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYR

SEQ ID NO: 331877 - protein, 16 aa, Artificial Sequence
  Description of Artificial Sequence: Synthetic peptide
  Seed: LRLVKRQVPLDCVLYR (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYR

SEQ ID NO: 331878 - protein, 16 aa, Artificial Sequence
  Description of Artificial Sequence: Synthetic peptide
  Seed: LRLVKRQVPLDCVLYR (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYR

SEQ ID NO: 331879 - protein, 16 aa, Artificial Sequence
  Description of Artificial Sequence: Synthetic peptide
  Seed: LRLVKRQVPLDCVLYR (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXR

SEQ ID NO: 331880 - protein, 17 aa, Artificial Sequence
  Description of Artificial Sequence: Synthetic peptide
  Seed: LRLVKRQVPLDCVLYRY (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRY

SEQ ID NO: 331881 - protein, 17 aa, Artificial Sequence
  Description of Artificial Sequence: Synthetic peptide
  Seed: LRLVKRQVPLDCVLYRY (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRY

SEQ ID NO: 331882 - protein, 17 aa, Artificial Sequence
  Description of Artificial Sequence: Synthetic peptide
  Seed: LRLVKRQVPLDCVLYRY (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRY

SEQ ID NO: 331883 - protein, 17 aa, Artificial Sequence
  Description of Artificial Sequence: Synthetic peptide
  Seed: LRLVKRQVPLDCVLYRY (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRY

SEQ ID NO: 331884 - protein, 17 aa, Artificial Sequence
  Description of Artificial Sequence: Synthetic peptide
  Seed: LRLVKRQVPLDCVLYRY (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXY

SEQ ID NO: 331885 - protein, 18 aa, Artificial Sequence
  Description of Artificial Sequence: Synthetic peptide
  Seed: LRLVKRQVPLDCVLYRYG (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRYG

SEQ ID NO: 331886 - protein, 19 aa, Artificial Sequence
  Description of Artificial Sequence: Synthetic peptide
  Seed: LRLVKRQVPLDCVLYRYGS (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRYGS

SEQ ID NO: 331887 - protein, 19 aa, Artificial Sequence
  Description of Artificial Sequence: Synthetic peptide
  Seed: LRLVKRQVPLDCVLYRYGS (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRYGS

SEQ ID NO: 331888 - protein, 19 aa, Artificial Sequence
  Description of Artificial Sequence: Synthetic peptide
  Seed: LRLVKRQVPLDCVLYRYGS (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRYGS

SEQ ID NO: 331889 - protein, 19 aa, Artificial Sequence
  Description of Artificial Sequence: Synthetic peptide
  Seed: LRLVKRQVPLDCVLYRYGS (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRYGS

SEQ ID NO: 331890 - protein, 19 aa, Artificial Sequence
  Description of Artificial Sequence: Synthetic peptide
  Seed: LRLVKRQVPLDCVLYRYGS (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGS

SEQ ID NO: 331891 - protein, 19 aa, Artificial Sequence
  Description of Artificial Sequence: Synthetic peptide
  Seed: LRLVKRQVPLDCVLYRYGS (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXS

SEQ ID NO: 331892 - protein, 20 aa, Artificial Sequence
  Description of Artificial Sequence: Synthetic peptide
  Seed: LRLVKRQVPLDCVLYRYGSF (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRYGSF

SEQ ID NO: 331893 - protein, 20 aa, Artificial Sequence
  Description of Artificial Sequence: Synthetic peptide
  Seed: LRLVKRQVPLDCVLYRYGSF (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRYGSF

SEQ ID NO: 331894 - protein, 20 aa, Artificial Sequence
  Description of Artificial Sequence: Synthetic peptide
  Seed: LRLVKRQVPLDCVLYRYGSF (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRYGSF

SEQ ID NO: 331895 - protein, 20 aa, Artificial Sequence
  Description of Artificial Sequence: Synthetic peptide
  Seed: LRLVKRQVPLDCVLYRYGSF (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRYGSF

SEQ ID NO: 331896 - protein, 20 aa, Artificial Sequence
  Description of Artificial Sequence: Synthetic peptide
  Seed: LRLVKRQVPLDCVLYRYGSF (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGSF

SEQ ID NO: 331897 - protein, 20 aa, Artificial Sequence
  Description of Artificial Sequence: Synthetic peptide
  Seed: LRLVKRQVPLDCVLYRYGSF (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXSF

SEQ ID NO: 331898 - protein, 21 aa, Artificial Sequence
  Description of Artificial Sequence: Synthetic peptide
  Seed: LRLVKRQVPLDCVLYRYGSFS (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRYGSFS

SEQ ID NO: 331899 - protein, 21 aa, Artificial Sequence
  Description of Artificial Sequence: Synthetic peptide
  Seed: LRLVKRQVPLDCVLYRYGSFS (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRYGSFS

SEQ ID NO: 331900 - protein, 21 aa, Artificial Sequence
  Description of Artificial Sequence: Synthetic peptide
  Seed: LRLVKRQVPLDCVLYRYGSFS (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRYGSFS

SEQ ID NO: 331901 - protein, 21 aa, Artificial Sequence
  Description of Artificial Sequence: Synthetic peptide
  Seed: LRLVKRQVPLDCVLYRYGSFS (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGSFS

SEQ ID NO: 331902 - protein, 21 aa, Artificial Sequence
  Description of Artificial Sequence: Synthetic peptide
  Seed: LRLVKRQVPLDCVLYRYGSFS (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXSFS

SEQ ID NO: 331903 - protein, 22 aa, Artificial Sequence
  Description of Artificial Sequence: Synthetic peptide
  Seed: LRLVKRQVPLDCVLYRYGSFSV (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRYGSFSV

SEQ ID NO: 331904 - protein, 22 aa, Artificial Sequence
  Description of Artificial Sequence: Synthetic peptide
  Seed: LRLVKRQVPLDCVLYRYGSFSV (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRYGSFSV

SEQ ID NO: 331905 - protein, 22 aa, Artificial Sequence
  Description of Artificial Sequence: Synthetic peptide
  Seed: LRLVKRQVPLDCVLYRYGSFSV (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRYGSFSV

SEQ ID NO: 331906 - protein, 22 aa, Artificial Sequence
  Description of Artificial Sequence: Synthetic peptide
  Seed: LRLVKRQVPLDCVLYRYGSFSV (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRYGSFSV

SEQ ID NO: 331907 - protein, 22 aa, Artificial Sequence
  Description of Artificial Sequence: Synthetic peptide
  Seed: LRLVKRQVPLDCVLYRYGSFSV (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGSFSV

SEQ ID NO: 331908 - protein, 22 aa, Artificial Sequence
  Description of Artificial Sequence: Synthetic peptide
  Seed: LRLVKRQVPLDCVLYRYGSFSV (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXSFSV

SEQ ID NO: 331909 - protein, 22 aa, Artificial Sequence
  Description of Artificial Sequence: Synthetic peptide
  Seed: LRLVKRQVPLDCVLYRYGSFSV (PMEL_HUMAN)
  Core: LYRYGSFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVXYRXGXFSX

SEQ ID NO: 331910 - protein, 23 aa, Artificial Sequence
  Description of Artificial Sequence: Synthetic peptide
  Seed: LRLVKRQVPLDCVLYRYGSFSVT (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRYGSFSVT

SEQ ID NO: 331911 - protein, 23 aa, Artificial Sequence
  Description of Artificial Sequence: Synthetic peptide
  Seed: LRLVKRQVPLDCVLYRYGSFSVT (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRYGSFSVT

SEQ ID NO: 331912 - protein, 23 aa, Artificial Sequence
  Description of Artificial Sequence: Synthetic peptide
  Seed: LRLVKRQVPLDCVLYRYGSFSVT (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRYGSFSVT

SEQ ID NO: 331913 - protein, 23 aa, Artificial Sequence
  Description of Artificial Sequence: Synthetic peptide
  Seed: LRLVKRQVPLDCVLYRYGSFSVT (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGSFSVT

SEQ ID NO: 331914 - protein, 23 aa, Artificial Sequence
  Description of Artificial Sequence: Synthetic peptide
  Seed: LRLVKRQVPLDCVLYRYGSFSVT (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXSFSVT

SEQ ID NO: 331915 - protein, 23 aa, Artificial Sequence
  Description of Artificial Sequence: Synthetic peptide
  Seed: LRLVKRQVPLDCVLYRYGSFSVT (PMEL_HUMAN)
  Core: CVLYRYGSF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDXVLXRXGSXSVT

SEQ ID NO: 331916 - protein, 23 aa, Artificial Sequence
  Description of Artificial Sequence: Synthetic peptide
  Seed: LRLVKRQVPLDCVLYRYGSFSVT (PMEL_HUMAN)
  Core: LYRYGSFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVXYRXGXFSXT

SEQ ID NO: 331917 - protein, 23 aa, Artificial Sequence
  Description of Artificial Sequence: Synthetic peptide
  Seed: LRLVKRQVPLDCVLYRYGSFSVT (PMEL_HUMAN)
  Core: YRYGSFSVT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVLXRYXSXSVX

SEQ ID NO: 331918 - protein, 24 aa, Artificial Sequence
  Description of Artificial Sequence: Synthetic peptide
  Seed: LRLVKRQVPLDCVLYRYGSFSVTL (PMEL_HUMAN)
  Core: LVKRQVPLD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXVKXQXPLXCVLYRYGSFSVTL

SEQ ID NO: 331919 - protein, 24 aa, Artificial Sequence
  Description of Artificial Sequence: Synthetic peptide
  Seed: LRLVKRQVPLDCVLYRYGSFSVTL (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRYGSFSVTL

SEQ ID NO: 331920 - protein, 24 aa, Artificial Sequence
  Description of Artificial Sequence: Synthetic peptide
  Seed: LRLVKRQVPLDCVLYRYGSFSVTL (PMEL_HUMAN)
  Core: KRQVPLDCV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRLVXRQXPXDCXLYRYGSFSVTL

SEQ ID NO: 331921 - protein, 24 aa, Artificial Sequence
  Description of Artificial Sequence: Synthetic peptide
  Seed: LRLVKRQVPLDCVLYRYGSFSVTL (PMEL_HUMAN)
  Core: RQVPLDCVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKXQVXLXCVXYRYGSFSVTL

SEQ ID NO: 331922 - protein, 24 aa, Artificial Sequence
  Description of Artificial Sequence: Synthetic peptide
  Seed: LRLVKRQVPLDCVLYRYGSFSVTL (PMEL_HUMAN)
  Core: QVPLDCVLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRXVPXDXVLXRYGSFSVTL

SEQ ID NO: 331923 - protein, 24 aa, Artificial Sequence
  Description of Artificial Sequence: Synthetic peptide
  Seed: LRLVKRQVPLDCVLYRYGSFSVTL (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGSFSVTL

SEQ ID NO: 331924 - protein, 24 aa, Artificial Sequence
  Description of Artificial Sequence: Synthetic peptide
  Seed: LRLVKRQVPLDCVLYRYGSFSVTL (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXSFSVTL

SEQ ID NO: 331925 - protein, 24 aa, Artificial Sequence
  Description of Artificial Sequence: Synthetic peptide
  Seed: LRLVKRQVPLDCVLYRYGSFSVTL (PMEL_HUMAN)
  Core: CVLYRYGSF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDXVLXRXGSXSVTL

SEQ ID NO: 331926 - protein, 24 aa, Artificial Sequence
  Description of Artificial Sequence: Synthetic peptide
  Seed: LRLVKRQVPLDCVLYRYGSFSVTL (PMEL_HUMAN)
  Core: LYRYGSFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVXYRXGXFSXTL

SEQ ID NO: 331927 - protein, 24 aa, Artificial Sequence
  Description of Artificial Sequence: Synthetic peptide
  Seed: LRLVKRQVPLDCVLYRYGSFSVTL (PMEL_HUMAN)
  Core: YRYGSFSVT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVLXRYXSXSVXL

SEQ ID NO: 331928 - protein, 25 aa, Artificial Sequence
  Description of Artificial Sequence: Synthetic peptide
  Seed: LRLVKRQVPLDCVLYRYGSFSVTLD (PMEL_HUMAN)
  Core: VKRQVPLDC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LRLXKRXVXLDXVLYRYGSFSVTLD

SEQ ID NO: 331929 - protein, 25 aa, Artificial Sequence
  Description of Artificial Sequence: Synthetic peptide
  Seed: LRLVKRQVPLDCVLYRYGSFSVTLD (PMEL_HUMAN)
  Core: VPLDCVLYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQXPLXCXLYXYGSFSVTLD

SEQ ID NO: 331930 - protein, 25 aa, Artificial Sequence
  Description of Artificial Sequence: Synthetic peptide
  Seed: LRLVKRQVPLDCVLYRYGSFSVTLD (PMEL_HUMAN)
  Core: LDCVLYRYG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPXDCXLXRYXSFSVTLD

SEQ ID NO: 331931 - protein, 25 aa, Artificial Sequence
  Description of Artificial Sequence: Synthetic peptide
  Seed: LRLVKRQVPLDCVLYRYGSFSVTLD (PMEL_HUMAN)
  Core: LYRYGSFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVXYRXGXFSXTLD

SEQ ID NO: 331932 - protein, 25 aa, Artificial Sequence
  Description of Artificial Sequence: Synthetic peptide
  Seed: LRLVKRQVPLDCVLYRYGSFSVTLD (PMEL_HUMAN)
  Core: YRYGSFSVT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVLXRYXSXSVXLD

SEQ ID NO: 331933 - protein, 25 aa, Artificial Sequence
  Description of Artificial Sequence: Synthetic peptide
  Seed: LRLVKRQVPLDCVLYRYGSFSVTLD (PMEL_HUMAN)
  Core: RYGSFSVTL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVLYXYGXFXVTXD

SEQ ID NO: 331934 - protein, 25 aa, Artificial Sequence
  Description of Artificial Sequence: Synthetic peptide
  Seed: LRLVKRQVPLDCVLYRYGSFSVTLD (PMEL_HUMAN)
  Core: YGSFSVTLD
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LRLVKRQVPLDCVLYRXGSXSXTLX

SEQ ID NO: 331935 - protein, 14 aa, Artificial Sequence
  Description of Artificial Sequence: Synthetic peptide
  Seed: LRNQPLTFALQLHD (PMEL_HUMAN)
  Core: PLTFALQLH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRNQXLTXAXQLXD

SEQ ID NO: 331936 - protein, 14 aa, Artificial Sequence
  Description of Artificial Sequence: Synthetic peptide
  Seed: LRNQPLTFALQLHD (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHX

SEQ ID NO: 331937 - protein, 15 aa, Artificial Sequence
  Description of Artificial Sequence: Synthetic peptide
  Seed: LRNQPLTFALQLHDP (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXP

SEQ ID NO: 331938 - protein, 16 aa, Artificial Sequence
  Description of Artificial Sequence: Synthetic peptide
  Seed: LRNQPLTFALQLHDPS (PMEL_HUMAN)
  Core: PLTFALQLH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRNQXLTXAXQLXDPS

SEQ ID NO: 331939 - protein, 16 aa, Artificial Sequence
  Description of Artificial Sequence: Synthetic peptide
  Seed: LRNQPLTFALQLHDPS (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPS

SEQ ID NO: 331940 - protein, 17 aa, Artificial Sequence
  Description of Artificial Sequence: Synthetic peptide
  Seed: LRNQPLTFALQLHDPSG (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSG

SEQ ID NO: 331941 - protein, 18 aa, Artificial Sequence
  Description of Artificial Sequence: Synthetic peptide
  Seed: LRNQPLTFALQLHDPSGY (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGY

SEQ ID NO: 331942 - protein, 19 aa, Artificial Sequence
  Description of Artificial Sequence: Synthetic peptide
  Seed: LRNQPLTFALQLHDPSGYL (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYL

SEQ ID NO: 331943 - protein, 19 aa, Artificial Sequence
  Description of Artificial Sequence: Synthetic peptide
  Seed: LRNQPLTFALQLHDPSGYL (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYL

SEQ ID NO: 331944 - protein, 20 aa, Artificial Sequence
  Description of Artificial Sequence: Synthetic peptide
  Seed: LRNQPLTFALQLHDPSGYLA (PMEL_HUMAN)
  Core: PLTFALQLH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRNQXLTXAXQLXDPSGYLA

SEQ ID NO: 331945 - protein, 20 aa, Artificial Sequence
  Description of Artificial Sequence: Synthetic peptide
  Seed: LRNQPLTFALQLHDPSGYLA (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYLA

SEQ ID NO: 331946 - protein, 20 aa, Artificial Sequence
  Description of Artificial Sequence: Synthetic peptide
  Seed: LRNQPLTFALQLHDPSGYLA (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYLA

SEQ ID NO: 331947 - protein, 20 aa, Artificial Sequence
  Description of Artificial Sequence: Synthetic peptide
  Seed: LRNQPLTFALQLHDPSGYLA (PMEL_HUMAN)
  Core: LQLHDPSGY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFAXQLXDXSGXLA

SEQ ID NO: 331948 - protein, 21 aa, Artificial Sequence
  Description of Artificial Sequence: Synthetic peptide
  Seed: LRNQPLTFALQLHDPSGYLAE (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYLAE

SEQ ID NO: 331949 - protein, 21 aa, Artificial Sequence
  Description of Artificial Sequence: Synthetic peptide
  Seed: LRNQPLTFALQLHDPSGYLAE (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYLAE

SEQ ID NO: 331950 - protein, 21 aa, Artificial Sequence
  Description of Artificial Sequence: Synthetic peptide
  Seed: LRNQPLTFALQLHDPSGYLAE (PMEL_HUMAN)
  Core: LQLHDPSGY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFAXQLXDXSGXLAE

SEQ ID NO: 331951 - protein, 22 aa, Artificial Sequence
  Description of Artificial Sequence: Synthetic peptide
  Seed: LRNQPLTFALQLHDPSGYLAEA (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYLAEA

SEQ ID NO: 331952 - protein, 22 aa, Artificial Sequence
  Description of Artificial Sequence: Synthetic peptide
  Seed: LRNQPLTFALQLHDPSGYLAEA (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYLAEA

SEQ ID NO: 331953 - protein, 22 aa, Artificial Sequence
  Description of Artificial Sequence: Synthetic peptide
  Seed: LRNQPLTFALQLHDPSGYLAEA (PMEL_HUMAN)
  Core: LQLHDPSGY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFAXQLXDXSGXLAEA

SEQ ID NO: 331954 - protein, 23 aa, Artificial Sequence
  Description of Artificial Sequence: Synthetic peptide
  Seed: LRNQPLTFALQLHDPSGYLAEAD (PMEL_HUMAN)
  Core: PLTFALQLH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRNQXLTXAXQLXDPSGYLAEAD

SEQ ID NO: 331955 - protein, 23 aa, Artificial Sequence
  Description of Artificial Sequence: Synthetic peptide
  Seed: LRNQPLTFALQLHDPSGYLAEAD (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYLAEAD

SEQ ID NO: 331956 - protein, 23 aa, Artificial Sequence
  Description of Artificial Sequence: Synthetic peptide
  Seed: LRNQPLTFALQLHDPSGYLAEAD (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYLAEAD

SEQ ID NO: 331957 - protein, 23 aa, Artificial Sequence
  Description of Artificial Sequence: Synthetic peptide
  Seed: LRNQPLTFALQLHDPSGYLAEAD (PMEL_HUMAN)
  Core: LQLHDPSGY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFAXQLXDXSGXLAEAD

SEQ ID NO: 331958 - protein, 23 aa, Artificial Sequence
  Description of Artificial Sequence: Synthetic peptide
  Seed: LRNQPLTFALQLHDPSGYLAEAD (PMEL_HUMAN)
  Core: LHDPSGYLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFALQXHDXSXYLXEAD

SEQ ID NO: 331959 - protein, 24 aa, Artificial Sequence
  Description of Artificial Sequence: Synthetic peptide
  Seed: LRNQPLTFALQLHDPSGYLAEADL (PMEL_HUMAN)
  Core: PLTFALQLH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRNQXLTXAXQLXDPSGYLAEADL

SEQ ID NO: 331960 - protein, 24 aa, Artificial Sequence
  Description of Artificial Sequence: Synthetic peptide
  Seed: LRNQPLTFALQLHDPSGYLAEADL (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYLAEADL

SEQ ID NO: 331961 - protein, 24 aa, Artificial Sequence
  Description of Artificial Sequence: Synthetic peptide
  Seed: LRNQPLTFALQLHDPSGYLAEADL (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYLAEADL

SEQ ID NO: 331962 - protein, 24 aa, Artificial Sequence
  Description of Artificial Sequence: Synthetic peptide
  Seed: LRNQPLTFALQLHDPSGYLAEADL (PMEL_HUMAN)
  Core: LQLHDPSGY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFAXQLXDXSGXLAEADL

SEQ ID NO: 331963 - protein, 24 aa, Artificial Sequence
  Description of Artificial Sequence: Synthetic peptide
  Seed: LRNQPLTFALQLHDPSGYLAEADL (PMEL_HUMAN)
  Core: LHDPSGYLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFALQXHDXSXYLXEADL

SEQ ID NO: 331964 - protein, 24 aa, Artificial Sequence
  Description of Artificial Sequence: Synthetic peptide
  Seed: LRNQPLTFALQLHDPSGYLAEADL (PMEL_HUMAN)
  Core: PSGYLAEAD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFALQLHDXSGXLXEAXL

SEQ ID NO: 331965 - protein, 25 aa, Artificial Sequence
  Description of Artificial Sequence: Synthetic peptide
  Seed: LRNQPLTFALQLHDPSGYLAEADLS (PMEL_HUMAN)
  Core: PLTFALQLH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LRNQXLTXAXQLXDPSGYLAEADLS

SEQ ID NO: 331966 - protein, 25 aa, Artificial Sequence
  Description of Artificial Sequence: Synthetic peptide
  Seed: LRNQPLTFALQLHDPSGYLAEADLS (PMEL_HUMAN)
  Core: LTFALQLHD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPXTFXLXLHXPSGYLAEADLS

SEQ ID NO: 331967 - protein, 25 aa, Artificial Sequence
  Description of Artificial Sequence: Synthetic peptide
  Seed: LRNQPLTFALQLHDPSGYLAEADLS (PMEL_HUMAN)
  Core: FALQLHDPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTXALXLXDPXGYLAEADLS

SEQ ID NO: 331968 - protein, 25 aa, Artificial Sequence
  Description of Artificial Sequence: Synthetic peptide
  Seed: LRNQPLTFALQLHDPSGYLAEADLS (PMEL_HUMAN)
  Core: LQLHDPSGY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFAXQLXDXSGXLAEADLS

SEQ ID NO: 331969 - protein, 25 aa, Artificial Sequence
  Description of Artificial Sequence: Synthetic peptide
  Seed: LRNQPLTFALQLHDPSGYLAEADLS (PMEL_HUMAN)
  Core: LHDPSGYLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFALQXHDXSXYLXEADLS

SEQ ID NO: 331970 - protein, 25 aa, Artificial Sequence
  Description of Artificial Sequence: Synthetic peptide
  Seed: LRNQPLTFALQLHDPSGYLAEADLS (PMEL_HUMAN)
  Core: PSGYLAEAD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LRNQPLTFALQLHDXSGXLXEAXLS

SEQ ID NO: 331971 - protein, 14 aa, Artificial Sequence
  Description of Artificial Sequence: Synthetic peptide
  Seed: LRTKAWNRQLYPEW (PMEL_HUMAN)
  Core: TKAWNRQLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXKAXNXQLXPEW

SEQ ID NO: 331972 - protein, 15 aa, Artificial Sequence
  Description of Artificial Sequence: Synthetic peptide
  Seed: LRTKAWNRQLYPEWT (PMEL_HUMAN)
  Core: TKAWNRQLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXKAXNXQLXPEWT

SEQ ID NO: 331973 - protein, 16 aa, Artificial Sequence
  Description of Artificial Sequence: Synthetic peptide
  Seed: LRTKAWNRQLYPEWTE (PMEL_HUMAN)
  Core: TKAWNRQLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXKAXNXQLXPEWTE

SEQ ID NO: 331974 - protein, 17 aa, Artificial Sequence
  Description of Artificial Sequence: Synthetic peptide
  Seed: LRTKAWNRQLYPEWTEA (PMEL_HUMAN)
  Core: TKAWNRQLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXKAXNXQLXPEWTEA

SEQ ID NO: 331975 - protein, 19 aa, Artificial Sequence
  Description of Artificial Sequence: Synthetic peptide
  Seed: LRTKAWNRQLYPEWTEAQR (PMEL_HUMAN)
  Core: TKAWNRQLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXKAXNXQLXPEWTEAQR

SEQ ID NO: 331976 - protein, 19 aa, Artificial Sequence
  Description of Artificial Sequence: Synthetic peptide
  Seed: LRTKAWNRQLYPEWTEAQR (PMEL_HUMAN)
  Core: NRQLYPEWT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWXRQXYXEWXEAQR

SEQ ID NO: 331977 - protein, 20 aa, Artificial Sequence
  Description of Artificial Sequence: Synthetic peptide
  Seed: LRTKAWNRQLYPEWTEAQRL (PMEL_HUMAN)
  Core: TKAWNRQLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LRXKAXNXQLXPEWTEAQRL

SEQ ID NO: 331978 - protein, 20 aa, Artificial Sequence
  Description of Artificial Sequence: Synthetic peptide
  Seed: LRTKAWNRQLYPEWTEAQRL (PMEL_HUMAN)
  Core: WNRQLYPEW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAXNRXLXPEXTEAQRL

SEQ ID NO: 331979 - protein, 20 aa, Artificial Sequence
  Description of Artificial Sequence: Synthetic peptide
  Seed: LRTKAWNRQLYPEWTEAQRL (PMEL_HUMAN)
  Core: NRQLYPEWT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWXRQXYXEWXEAQRL

SEQ ID NO: 331980 - protein, 20 aa, Artificial Sequence
  Description of Artificial Sequence: Synthetic peptide
  Seed: LRTKAWNRQLYPEWTEAQRL (PMEL_HUMAN)
  Core: QLYPEWTEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRXLYXEXTEXQRL

SEQ ID NO: 331981 - protein, 20 aa, Artificial Sequence
  Description of Artificial Sequence: Synthetic peptide
  Seed: LRTKAWNRQLYPEWTEAQRL (PMEL_HUMAN)
  Core: LYPEWTEAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRQXYPXWXEAXRL

SEQ ID NO: 331982 - protein, 21 aa, Artificial Sequence
  Description of Artificial Sequence: Synthetic peptide
  Seed: LRTKAWNRQLYPEWTEAQRLD (PMEL_HUMAN)
  Core: LYPEWTEAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRQXYPXWXEAXRLD

SEQ ID NO: 331983 - protein, 22 aa, Artificial Sequence
  Description of Artificial Sequence: Synthetic peptide
  Seed: LRTKAWNRQLYPEWTEAQRLDC (PMEL_HUMAN)
  Core: LYPEWTEAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRQXYPXWXEAXRLDC

SEQ ID NO: 331984 - protein, 23 aa, Artificial Sequence
  Description of Artificial Sequence: Synthetic peptide
  Seed: LRTKAWNRQLYPEWTEAQRLDCW (PMEL_HUMAN)
  Core: LYPEWTEAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRQXYPXWXEAXRLDCW

SEQ ID NO: 331985 - protein, 24 aa, Artificial Sequence
  Description of Artificial Sequence: Synthetic peptide
  Seed: LRTKAWNRQLYPEWTEAQRLDCWR (PMEL_HUMAN)
  Core: LYPEWTEAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRQXYPXWXEAXRLDCWR

SEQ ID NO: 331986 - protein, 25 aa, Artificial Sequence
  Description of Artificial Sequence: Synthetic peptide
  Seed: LRTKAWNRQLYPEWTEAQRLDCWRG (PMEL_HUMAN)
  Core: LYPEWTEAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LRTKAWNRQXYPXWXEAXRLDCWRG

SEQ ID NO: 331987 - protein, 13 aa, Artificial Sequence
  Description of Artificial Sequence: Synthetic peptide
  Seed: LSGTTAAQVTTTE (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXE

SEQ ID NO: 331988 - protein, 14 aa, Artificial Sequence
  Description of Artificial Sequence: Synthetic peptide
  Seed: LSGTTAAQVTTTEW (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEW

SEQ ID NO: 331989 - protein, 15 aa, Artificial Sequence
  Description of Artificial Sequence: Synthetic peptide
  Seed: LSGTTAAQVTTTEWV (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWV

SEQ ID NO: 331990 - protein, 16 aa, Artificial Sequence
  Description of Artificial Sequence: Synthetic peptide
  Seed: LSGTTAAQVTTTEWVE (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVE

SEQ ID NO: 331991 - protein, 16 aa, Artificial Sequence
  Description of Artificial Sequence: Synthetic peptide
  Seed: LSGTTAAQVTTTEWVE (PMEL_HUMAN)
  Core: AAQVTTTEW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTXAQXTXTEXVE

SEQ ID NO: 331992 - protein, 16 aa, Artificial Sequence
  Description of Artificial Sequence: Synthetic peptide
  Seed: LSGTTAAQVTTTEWVE (PMEL_HUMAN)
  Core: QVTTTEWVE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAXVTXTXWVX

SEQ ID NO: 331993 - protein, 17 aa, Artificial Sequence
  Description of Artificial Sequence: Synthetic peptide
  Seed: LSGTTAAQVTTTEWVET (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVET

SEQ ID NO: 331994 - protein, 17 aa, Artificial Sequence
  Description of Artificial Sequence: Synthetic peptide
  Seed: LSGTTAAQVTTTEWVET (PMEL_HUMAN)
  Core: QVTTTEWVE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAXVTXTXWVXT

SEQ ID NO: 331995 - protein, 18 aa, Artificial Sequence
  Description of Artificial Sequence: Synthetic peptide
  Seed: LSGTTAAQVTTTEWVETT (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETT

SEQ ID NO: 331996 - protein, 19 aa, Artificial Sequence
  Description of Artificial Sequence: Synthetic peptide
  Seed: LSGTTAAQVTTTEWVETTA (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTA

SEQ ID NO: 331997 - protein, 20 aa, Artificial Sequence
  Description of Artificial Sequence: Synthetic peptide
  Seed: LSGTTAAQVTTTEWVETTAR (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTAR

SEQ ID NO: 331998 - protein, 20 aa, Artificial Sequence
  Description of Artificial Sequence: Synthetic peptide
  Seed: LSGTTAAQVTTTEWVETTAR (PMEL_HUMAN)
  Core: QVTTTEWVE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAXVTXTXWVXTTAR

SEQ ID NO: 331999 - protein, 20 aa, Artificial Sequence
  Description of Artificial Sequence: Synthetic peptide
  Seed: LSGTTAAQVTTTEWVETTAR (PMEL_HUMAN)
  Core: VTTTEWVET
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQXTTXEXVEXTAR

SEQ ID NO: 332000 - protein, 21 aa, Artificial Sequence
  Description of Artificial Sequence: Synthetic peptide
  Seed: LSGTTAAQVTTTEWVETTARE (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTARE

SEQ ID NO: 332001 - protein, 21 aa, Artificial Sequence
  Description of Artificial Sequence: Synthetic peptide
  Seed: LSGTTAAQVTTTEWVETTARE (PMEL_HUMAN)
  Core: VTTTEWVET
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQXTTXEXVEXTARE

SEQ ID NO: 332002 - protein, 22 aa, Artificial Sequence
  Description of Artificial Sequence: Synthetic peptide
  Seed: LSGTTAAQVTTTEWVETTAREL (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTAREL

SEQ ID NO: 332003 - protein, 22 aa, Artificial Sequence
  Description of Artificial Sequence: Synthetic peptide
  Seed: LSGTTAAQVTTTEWVETTAREL (PMEL_HUMAN)
  Core: VTTTEWVET
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQXTTXEXVEXTAREL

SEQ ID NO: 332004 - protein, 22 aa, Artificial Sequence
  Description of Artificial Sequence: Synthetic peptide
  Seed: LSGTTAAQVTTTEWVETTAREL (PMEL_HUMAN)
  Core: TTEWVETTA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVTXTEXVXTTXREL

SEQ ID NO: 332005 - protein, 22 aa, Artificial Sequence
  Description of Artificial Sequence: Synthetic peptide
  Seed: LSGTTAAQVTTTEWVETTAREL (PMEL_HUMAN)
  Core: WVETTAREL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVTTTEXVEXTXREX

SEQ ID NO: 332006 - protein, 23 aa, Artificial Sequence
  Description of Artificial Sequence: Synthetic peptide
  Seed: LSGTTAAQVTTTEWVETTARELP (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTARELP

SEQ ID NO: 332007 - protein, 23 aa, Artificial Sequence
  Description of Artificial Sequence: Synthetic peptide
  Seed: LSGTTAAQVTTTEWVETTARELP (PMEL_HUMAN)
  Core: VTTTEWVET
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQXTTXEXVEXTARELP

SEQ ID NO: 332008 - protein, 23 aa, Artificial Sequence
  Description of Artificial Sequence: Synthetic peptide
  Seed: LSGTTAAQVTTTEWVETTARELP (PMEL_HUMAN)
  Core: TTTEWVETT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVXTTXWXETXARELP

SEQ ID NO: 332009 - protein, 23 aa, Artificial Sequence
  Description of Artificial Sequence: Synthetic peptide
  Seed: LSGTTAAQVTTTEWVETTARELP (PMEL_HUMAN)
  Core: TTEWVETTA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVTXTEXVXTTXRELP

SEQ ID NO: 332010 - protein, 23 aa, Artificial Sequence
  Description of Artificial Sequence: Synthetic peptide
  Seed: LSGTTAAQVTTTEWVETTARELP (PMEL_HUMAN)
  Core: WVETTAREL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVTTTEXVEXTXREXP

SEQ ID NO: 332011 - protein, 24 aa, Artificial Sequence
  Description of Artificial Sequence: Synthetic peptide
  Seed: LSGTTAAQVTTTEWVETTARELPI (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTARELPI

SEQ ID NO: 332012 - protein, 24 aa, Artificial Sequence
  Description of Artificial Sequence: Synthetic peptide
  Seed: LSGTTAAQVTTTEWVETTARELPI (PMEL_HUMAN)
  Core: QVTTTEWVE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAXVTXTXWVXTTARELPI

SEQ ID NO: 332013 - protein, 24 aa, Artificial Sequence
  Description of Artificial Sequence: Synthetic peptide
  Seed: LSGTTAAQVTTTEWVETTARELPI (PMEL_HUMAN)
  Core: VTTTEWVET
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQXTTXEXVEXTARELPI

SEQ ID NO: 332014 - protein, 24 aa, Artificial Sequence
  Description of Artificial Sequence: Synthetic peptide
  Seed: LSGTTAAQVTTTEWVETTARELPI (PMEL_HUMAN)
  Core: TTTEWVETT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVXTTXWXETXARELPI

SEQ ID NO: 332015 - protein, 24 aa, Artificial Sequence
  Description of Artificial Sequence: Synthetic peptide
  Seed: LSGTTAAQVTTTEWVETTARELPI (PMEL_HUMAN)
  Core: WVETTAREL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVTTTEXVEXTXREXPI

SEQ ID NO: 332016 - protein, 25 aa, Artificial Sequence
  Description of Artificial Sequence: Synthetic peptide
  Seed: LSGTTAAQVTTTEWVETTARELPIP (PMEL_HUMAN)
  Core: TTAAQVTTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSGXTAXQXTTXEWVETTARELPIP

SEQ ID NO: 332017 - protein, 25 aa, Artificial Sequence
  Description of Artificial Sequence: Synthetic peptide
  Seed: LSGTTAAQVTTTEWVETTARELPIP (PMEL_HUMAN)
  Core: VTTTEWVET
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQXTTXEXVEXTARELPIP

SEQ ID NO: 332018 - protein, 25 aa, Artificial Sequence
  Description of Artificial Sequence: Synthetic peptide
  Seed: LSGTTAAQVTTTEWVETTARELPIP (PMEL_HUMAN)
  Core: WVETTAREL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSGTTAAQVTTTEXVEXTXREXPIP

SEQ ID NO: 332019 - protein, 13 aa, Artificial Sequence
  Description of Artificial Sequence: Synthetic peptide
  Seed: LSIGTGRAMLGTH (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTH

SEQ ID NO: 332020 - protein, 14 aa, Artificial Sequence
  Description of Artificial Sequence: Synthetic peptide
  Seed: LSIGTGRAMLGTHT (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHT

SEQ ID NO: 332021 - protein, 15 aa, Artificial Sequence
  Description of Artificial Sequence: Synthetic peptide
  Seed: LSIGTGRAMLGTHTM (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTM

SEQ ID NO: 332022 - protein, 16 aa, Artificial Sequence
  Description of Artificial Sequence: Synthetic peptide
  Seed: LSIGTGRAMLGTHTME (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTME

SEQ ID NO: 332023 - protein, 16 aa, Artificial Sequence
  Description of Artificial Sequence: Synthetic peptide
  Seed: LSIGTGRAMLGTHTME (PMEL_HUMAN)
  Core: GRAMLGTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTXRAXLXTHXME

SEQ ID NO: 332024 - protein, 17 aa, Artificial Sequence
  Description of Artificial Sequence: Synthetic peptide
  Seed: LSIGTGRAMLGTHTMEV (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEV

SEQ ID NO: 332025 - protein, 17 aa, Artificial Sequence
  Description of Artificial Sequence: Synthetic peptide
  Seed: LSIGTGRAMLGTHTMEV (PMEL_HUMAN)
  Core: GRAMLGTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTXRAXLXTHXMEV

SEQ ID NO: 332026 - protein, 17 aa, Artificial Sequence
  Description of Artificial Sequence: Synthetic peptide
  Seed: LSIGTGRAMLGTHTMEV (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEV

SEQ ID NO: 332027 - protein, 17 aa, Artificial Sequence
  Description of Artificial Sequence: Synthetic peptide
  Seed: LSIGTGRAMLGTHTMEV (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEX

SEQ ID NO: 332028 - protein, 18 aa, Artificial Sequence
  Description of Artificial Sequence: Synthetic peptide
  Seed: LSIGTGRAMLGTHTMEVT (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVT

SEQ ID NO: 332029 - protein, 18 aa, Artificial Sequence
  Description of Artificial Sequence: Synthetic peptide
  Seed: LSIGTGRAMLGTHTMEVT (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXT

SEQ ID NO: 332030 - protein, 19 aa, Artificial Sequence
  Description of Artificial Sequence: Synthetic peptide
  Seed: LSIGTGRAMLGTHTMEVTV (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTV

SEQ ID NO: 332031 - protein, 19 aa, Artificial Sequence
  Description of Artificial Sequence: Synthetic peptide
  Seed: LSIGTGRAMLGTHTMEVTV (PMEL_HUMAN)
  Core: GRAMLGTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTXRAXLXTHXMEVTV

SEQ ID NO: 332032 - protein, 19 aa, Artificial Sequence
  Description of Artificial Sequence: Synthetic peptide
  Seed: LSIGTGRAMLGTHTMEVTV (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTV

SEQ ID NO: 332033 - protein, 19 aa, Artificial Sequence
  Description of Artificial Sequence: Synthetic peptide
  Seed: LSIGTGRAMLGTHTMEVTV (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTV

SEQ ID NO: 332034 - protein, 20 aa, Artificial Sequence
  Description of Artificial Sequence: Synthetic peptide
  Seed: LSIGTGRAMLGTHTMEVTVY (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTVY

SEQ ID NO: 332035 - protein, 20 aa, Artificial Sequence
  Description of Artificial Sequence: Synthetic peptide
  Seed: LSIGTGRAMLGTHTMEVTVY (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTVY

SEQ ID NO: 332036 - protein, 20 aa, Artificial Sequence
  Description of Artificial Sequence: Synthetic peptide
  Seed: LSIGTGRAMLGTHTMEVTVY (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTVY

SEQ ID NO: 332037 - protein, 21 aa, Artificial Sequence
  Description of Artificial Sequence: Synthetic peptide
  Seed: LSIGTGRAMLGTHTMEVTVYH (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTVYH

SEQ ID NO: 332038 - protein, 21 aa, Artificial Sequence
  Description of Artificial Sequence: Synthetic peptide
  Seed: LSIGTGRAMLGTHTMEVTVYH (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTVYH

SEQ ID NO: 332039 - protein, 21 aa, Artificial Sequence
  Description of Artificial Sequence: Synthetic peptide
  Seed: LSIGTGRAMLGTHTMEVTVYH (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTVYH

SEQ ID NO: 332040 - protein, 21 aa, Artificial Sequence
  Description of Artificial Sequence: Synthetic peptide
  Seed: LSIGTGRAMLGTHTMEVTVYH (PMEL_HUMAN)
  Core: LGTHTMEVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMXGTXTXEVXVYH

SEQ ID NO: 332041 - protein, 22 aa, Artificial Sequence
  Description of Artificial Sequence: Synthetic peptide
  Seed: LSIGTGRAMLGTHTMEVTVYHR (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTVYHR

SEQ ID NO: 332042 - protein, 22 aa, Artificial Sequence
  Description of Artificial Sequence: Synthetic peptide
  Seed: LSIGTGRAMLGTHTMEVTVYHR (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTVYHR

SEQ ID NO: 332043 - protein, 22 aa, Artificial Sequence
  Description of Artificial Sequence: Synthetic peptide
  Seed: LSIGTGRAMLGTHTMEVTVYHR (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTVYHR

SEQ ID NO: 332044 - protein, 22 aa, Artificial Sequence
  Description of Artificial Sequence: Synthetic peptide
  Seed: LSIGTGRAMLGTHTMEVTVYHR (PMEL_HUMAN)
  Core: LGTHTMEVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMXGTXTXEVXVYHR

SEQ ID NO: 332045 - protein, 23 aa, Artificial Sequence
  Description of Artificial Sequence: Synthetic peptide
  Seed: LSIGTGRAMLGTHTMEVTVYHRR (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTVYHRR

SEQ ID NO: 332046 - protein, 23 aa, Artificial Sequence
  Description of Artificial Sequence: Synthetic peptide
  Seed: LSIGTGRAMLGTHTMEVTVYHRR (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTVYHRR

SEQ ID NO: 332047 - protein, 23 aa, Artificial Sequence
  Description of Artificial Sequence: Synthetic peptide
  Seed: LSIGTGRAMLGTHTMEVTVYHRR (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTVYHRR

SEQ ID NO: 332048 - protein, 23 aa, Artificial Sequence
  Description of Artificial Sequence: Synthetic peptide
  Seed: LSIGTGRAMLGTHTMEVTVYHRR (PMEL_HUMAN)
  Core: LGTHTMEVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMXGTXTXEVXVYHRR

SEQ ID NO: 332049 - protein, 23 aa, Artificial Sequence
  Description of Artificial Sequence: Synthetic peptide
  Seed: LSIGTGRAMLGTHTMEVTVYHRR (PMEL_HUMAN)
  Core: THTMEVTVY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGXHTXEXTVXHRR

SEQ ID NO: 332050 - protein, 23 aa, Artificial Sequence
  Description of Artificial Sequence: Synthetic peptide
  Seed: LSIGTGRAMLGTHTMEVTVYHRR (PMEL_HUMAN)
  Core: MEVTVYHRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGTHTXEVXVXHRX

SEQ ID NO: 332051 - protein, 24 aa, Artificial Sequence
  Description of Artificial Sequence: Synthetic peptide
  Seed: LSIGTGRAMLGTHTMEVTVYHRRG (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTVYHRRG

SEQ ID NO: 332052 - protein, 24 aa, Artificial Sequence
  Description of Artificial Sequence: Synthetic peptide
  Seed: LSIGTGRAMLGTHTMEVTVYHRRG (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTVYHRRG

SEQ ID NO: 332053 - protein, 24 aa, Artificial Sequence
  Description of Artificial Sequence: Synthetic peptide
  Seed: LSIGTGRAMLGTHTMEVTVYHRRG (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTVYHRRG

SEQ ID NO: 332054 - protein, 24 aa, Artificial Sequence
  Description of Artificial Sequence: Synthetic peptide
  Seed: LSIGTGRAMLGTHTMEVTVYHRRG (PMEL_HUMAN)
  Core: LGTHTMEVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMXGTXTXEVXVYHRRG

SEQ ID NO: 332055 - protein, 24 aa, Artificial Sequence
  Description of Artificial Sequence: Synthetic peptide
  Seed: LSIGTGRAMLGTHTMEVTVYHRRG (PMEL_HUMAN)
  Core: THTMEVTVY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGXHTXEXTVXHRRG

SEQ ID NO: 332056 - protein, 24 aa, Artificial Sequence
  Description of Artificial Sequence: Synthetic peptide
  Seed: LSIGTGRAMLGTHTMEVTVYHRRG (PMEL_HUMAN)
  Core: MEVTVYHRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGTHTXEVXVXHRXG

SEQ ID NO: 332057 - protein, 25 aa, Artificial Sequence
  Description of Artificial Sequence: Synthetic peptide
  Seed: LSIGTGRAMLGTHTMEVTVYHRRGS (PMEL_HUMAN)
  Core: IGTGRAMLG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LSXGTXRXMLXTHTMEVTVYHRRGS

SEQ ID NO: 332058 - protein, 25 aa, Artificial Sequence
  Description of Artificial Sequence: Synthetic peptide
  Seed: LSIGTGRAMLGTHTMEVTVYHRRGS (PMEL_HUMAN)
  Core: RAMLGTHTM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGXAMXGXHTXEVTVYHRRGS

SEQ ID NO: 332059 - protein, 25 aa, Artificial Sequence
  Description of Artificial Sequence: Synthetic peptide
  Seed: LSIGTGRAMLGTHTMEVTVYHRRGS (PMEL_HUMAN)
  Core: MLGTHTMEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAXLGXHXMEXTVYHRRGS

SEQ ID NO: 332060 - protein, 25 aa, Artificial Sequence
  Description of Artificial Sequence: Synthetic peptide
  Seed: LSIGTGRAMLGTHTMEVTVYHRRGS (PMEL_HUMAN)
  Core: LGTHTMEVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMXGTXTXEVXVYHRRGS

SEQ ID NO: 332061 - protein, 25 aa, Artificial Sequence
  Description of Artificial Sequence: Synthetic peptide
  Seed: LSIGTGRAMLGTHTMEVTVYHRRGS (PMEL_HUMAN)
  Core: THTMEVTVY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGXHTXEXTVXHRRGS

SEQ ID NO: 332062 - protein, 25 aa, Artificial Sequence
  Description of Artificial Sequence: Synthetic peptide
  Seed: LSIGTGRAMLGTHTMEVTVYHRRGS (PMEL_HUMAN)
  Core: MEVTVYHRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGTHTXEVXVXHRXGS

SEQ ID NO: 332063 - protein, 25 aa, Artificial Sequence
  Description of Artificial Sequence: Synthetic peptide
  Seed: LSIGTGRAMLGTHTMEVTVYHRRGS (PMEL_HUMAN)
  Core: VTVYHRRGS
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LSIGTGRAMLGTHTMEXTVXHXRGX

SEQ ID NO: 332064 - protein, 16 aa, Artificial Sequence
  Description of Artificial Sequence: Synthetic peptide
  Seed: LSYTWDFGDSSGTLIS (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLIS

SEQ ID NO: 332065 - protein, 17 aa, Artificial Sequence
  Description of Artificial Sequence: Synthetic peptide
  Seed: LSYTWDFGDSSGTLISR (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISR

SEQ ID NO: 332066 - protein, 18 aa, Artificial Sequence
  Description of Artificial Sequence: Synthetic peptide
  Seed: LSYTWDFGDSSGTLISRA (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRA

SEQ ID NO: 332067 - protein, 18 aa, Artificial Sequence
  Description of Artificial Sequence: Synthetic peptide
  Seed: LSYTWDFGDSSGTLISRA (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRX

SEQ ID NO: 332068 - protein, 19 aa, Artificial Sequence
  Description of Artificial Sequence: Synthetic peptide
  Seed: LSYTWDFGDSSGTLISRAL (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRAL

SEQ ID NO: 332069 - protein, 19 aa, Artificial Sequence
  Description of Artificial Sequence: Synthetic peptide
  Seed: LSYTWDFGDSSGTLISRAL (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRAL

SEQ ID NO: 332070 - protein, 19 aa, Artificial Sequence
  Description of Artificial Sequence: Synthetic peptide
  Seed: LSYTWDFGDSSGTLISRAL (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXL

SEQ ID NO: 332071 - protein, 20 aa, Artificial Sequence
  Description of Artificial Sequence: Synthetic peptide
  Seed: LSYTWDFGDSSGTLISRALV (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRALV

SEQ ID NO: 332072 - protein, 20 aa, Artificial Sequence
  Description of Artificial Sequence: Synthetic peptide
  Seed: LSYTWDFGDSSGTLISRALV (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRALV

SEQ ID NO: 332073 - protein, 20 aa, Artificial Sequence
  Description of Artificial Sequence: Synthetic peptide
  Seed: LSYTWDFGDSSGTLISRALV (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXLV

SEQ ID NO: 332074 - protein, 20 aa, Artificial Sequence
  Description of Artificial Sequence: Synthetic peptide
  Seed: LSYTWDFGDSSGTLISRALV (PMEL_HUMAN)
  Core: SGTLISRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSXGTXIXRAXV

SEQ ID NO: 332075 - protein, 21 aa, Artificial Sequence
  Description of Artificial Sequence: Synthetic peptide
  Seed: LSYTWDFGDSSGTLISRALVV (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRALVV

SEQ ID NO: 332076 - protein, 21 aa, Artificial Sequence
  Description of Artificial Sequence: Synthetic peptide
  Seed: LSYTWDFGDSSGTLISRALVV (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRALVV

SEQ ID NO: 332077 - protein, 21 aa, Artificial Sequence
  Description of Artificial Sequence: Synthetic peptide
  Seed: LSYTWDFGDSSGTLISRALVV (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXLVV

SEQ ID NO: 332078 - protein, 22 aa, Artificial Sequence
  Description of Artificial Sequence: Synthetic peptide
  Seed: LSYTWDFGDSSGTLISRALVVT (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRALVVT

SEQ ID NO: 332079 - protein, 22 aa, Artificial Sequence
  Description of Artificial Sequence: Synthetic peptide
  Seed: LSYTWDFGDSSGTLISRALVVT (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRALVVT

SEQ ID NO: 332080 - protein, 22 aa, Artificial Sequence
  Description of Artificial Sequence: Synthetic peptide
  Seed: LSYTWDFGDSSGTLISRALVVT (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXLVVT

SEQ ID NO: 332081 - protein, 22 aa, Artificial Sequence
  Description of Artificial Sequence: Synthetic peptide
  Seed: LSYTWDFGDSSGTLISRALVVT (PMEL_HUMAN)
  Core: TLISRALVV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGXLIXRXLVXT

SEQ ID NO: 332082 - protein, 23 aa, Artificial Sequence
  Description of Artificial Sequence: Synthetic peptide
  Seed: LSYTWDFGDSSGTLISRALVVTH (PMEL_HUMAN)
  Core: TWDFGDSSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSYXWDXGXSSXTLISRALVVTH

SEQ ID NO: 332083 - protein, 23 aa, Artificial Sequence
  Description of Artificial Sequence: Synthetic peptide
  Seed: LSYTWDFGDSSGTLISRALVVTH (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRALVVTH

SEQ ID NO: 332084 - protein, 23 aa, Artificial Sequence
  Description of Artificial Sequence: Synthetic peptide
  Seed: LSYTWDFGDSSGTLISRALVVTH (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRALVVTH

SEQ ID NO: 332085 - protein, 23 aa, Artificial Sequence
  Description of Artificial Sequence: Synthetic peptide
  Seed: LSYTWDFGDSSGTLISRALVVTH (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXLVVTH

SEQ ID NO: 332086 - protein, 23 aa, Artificial Sequence
  Description of Artificial Sequence: Synthetic peptide
  Seed: LSYTWDFGDSSGTLISRALVVTH (PMEL_HUMAN)
  Core: SGTLISRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSXGTXIXRAXVVTH

SEQ ID NO: 332087 - protein, 23 aa, Artificial Sequence
  Description of Artificial Sequence: Synthetic peptide
  Seed: LSYTWDFGDSSGTLISRALVVTH (PMEL_HUMAN)
  Core: TLISRALVV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGXLIXRXLVXTH

SEQ ID NO: 332088 - protein, 23 aa, Artificial Sequence
  Description of Artificial Sequence: Synthetic peptide
  Seed: LSYTWDFGDSSGTLISRALVVTH (PMEL_HUMAN)
  Core: LISRALVVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGTXISXAXVVXH

SEQ ID NO: 332089 - protein, 24 aa, Artificial Sequence
  Description of Artificial Sequence: Synthetic peptide
  Seed: LSYTWDFGDSSGTLISRALVVTHT (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRALVVTHT

SEQ ID NO: 332090 - protein, 24 aa, Artificial Sequence
  Description of Artificial Sequence: Synthetic peptide
  Seed: LSYTWDFGDSSGTLISRALVVTHT (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRALVVTHT

SEQ ID NO: 332091 - protein, 24 aa, Artificial Sequence
  Description of Artificial Sequence: Synthetic peptide
  Seed: LSYTWDFGDSSGTLISRALVVTHT (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXLVVTHT

SEQ ID NO: 332092 - protein, 24 aa, Artificial Sequence
  Description of Artificial Sequence: Synthetic peptide
  Seed: LSYTWDFGDSSGTLISRALVVTHT (PMEL_HUMAN)
  Core: SGTLISRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSXGTXIXRAXVVTHT

SEQ ID NO: 332093 - protein, 24 aa, Artificial Sequence
  Description of Artificial Sequence: Synthetic peptide
  Seed: LSYTWDFGDSSGTLISRALVVTHT (PMEL_HUMAN)
  Core: GTLISRALV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSXTLXSXALXVTHT

SEQ ID NO: 332094 - protein, 24 aa, Artificial Sequence
  Description of Artificial Sequence: Synthetic peptide
  Seed: LSYTWDFGDSSGTLISRALVVTHT (PMEL_HUMAN)
  Core: TLISRALVV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGXLIXRXLVXTHT

SEQ ID NO: 332095 - protein, 24 aa, Artificial Sequence
  Description of Artificial Sequence: Synthetic peptide
  Seed: LSYTWDFGDSSGTLISRALVVTHT (PMEL_HUMAN)
  Core: LISRALVVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGTXISXAXVVXHT

SEQ ID NO: 332096 - protein, 25 aa, Artificial Sequence
  Description of Artificial Sequence: Synthetic peptide
  Seed: LSYTWDFGDSSGTLISRALVVTHTY (PMEL_HUMAN)
  Core: WDFGDSSGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSYTXDFXDXSGXLISRALVVTHTY

SEQ ID NO: 332097 - protein, 25 aa, Artificial Sequence
  Description of Artificial Sequence: Synthetic peptide
  Seed: LSYTWDFGDSSGTLISRALVVTHTY (PMEL_HUMAN)
  Core: FGDSSGTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDXGDXSXTLXSRALVVTHTY

SEQ ID NO: 332098 - protein, 25 aa, Artificial Sequence
  Description of Artificial Sequence: Synthetic peptide
  Seed: LSYTWDFGDSSGTLISRALVVTHTY (PMEL_HUMAN)
  Core: SSGTLISRA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDXSGXLXSRXLVVTHTY

SEQ ID NO: 332099 - protein, 25 aa, Artificial Sequence
  Description of Artificial Sequence: Synthetic peptide
  Seed: LSYTWDFGDSSGTLISRALVVTHTY (PMEL_HUMAN)
  Core: SGTLISRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSXGTXIXRAXVVTHTY

SEQ ID NO: 332100 - protein, 25 aa, Artificial Sequence
  Description of Artificial Sequence: Synthetic peptide
  Seed: LSYTWDFGDSSGTLISRALVVTHTY (PMEL_HUMAN)
  Core: GTLISRALV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSXTLXSXALXVTHTY

SEQ ID NO: 332101 - protein, 25 aa, Artificial Sequence
  Description of Artificial Sequence: Synthetic peptide
  Seed: LSYTWDFGDSSGTLISRALVVTHTY (PMEL_HUMAN)
  Core: TLISRALVV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGXLIXRXLVXTHTY

SEQ ID NO: 332102 - protein, 25 aa, Artificial Sequence
  Description of Artificial Sequence: Synthetic peptide
  Seed: LSYTWDFGDSSGTLISRALVVTHTY (PMEL_HUMAN)
  Core: LISRALVVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGTXISXAXVVXHTY

SEQ ID NO: 332103 - protein, 25 aa, Artificial Sequence
  Description of Artificial Sequence: Synthetic peptide
  Seed: LSYTWDFGDSSGTLISRALVVTHTY (PMEL_HUMAN)
  Core: ISRALVVTH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGTLXSRXLXVTXTY

SEQ ID NO: 332104 - protein, 25 aa, Artificial Sequence
  Description of Artificial Sequence: Synthetic peptide
  Seed: LSYTWDFGDSSGTLISRALVVTHTY (PMEL_HUMAN)
  Core: SRALVVTHT
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LSYTWDFGDSSGTLIXRAXVXTHXY

SEQ ID NO: 332105 - protein, 14 aa, Artificial Sequence
  Description of Artificial Sequence: Synthetic peptide
  Seed: LTFALQLHDPSGYL (PMEL_HUMAN)
  Core: FALQLHDPS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LTXALXLXDPXGYL

SEQ ID NO: 332106 - protein, 14 aa, Artificial Sequence
  Description of Artificial Sequence: Synthetic peptide
  Seed: LTFALQLHDPSGYL (PMEL_HUMAN)
  Core: ALQLHDPSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LTFXLQXHXPSXYL

SEQ ID NO: 332107 - protein, 14 aa, Artificial Sequence
  Description of Artificial Sequence: Synthetic peptide
  Seed: LTFALQLHDPSGYL (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXL

SEQ ID NO: 332108 - protein, 15 aa, Artificial Sequence
  Description of Artificial Sequence: Synthetic peptide
  Seed: LTFALQLHDPSGYLA (PMEL_HUMAN)
  Core: FALQLHDPS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LTXALXLXDPXGYLA

SEQ ID NO: 332109 - protein, 15 aa, Artificial Sequence
  Description of Artificial Sequence: Synthetic peptide
  Seed: LTFALQLHDPSGYLA (PMEL_HUMAN)
  Core: ALQLHDPSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LTFXLQXHXPSXYLA

SEQ ID NO: 332110 - protein, 15 aa, Artificial Sequence
  Description of Artificial Sequence: Synthetic peptide
  Seed: LTFALQLHDPSGYLA (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLA

SEQ ID NO: 332111 - protein, 16 aa, Artificial Sequence
  Description of Artificial Sequence: Synthetic peptide
  Seed: LTFALQLHDPSGYLAE (PMEL_HUMAN)
  Core: FALQLHDPS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LTXALXLXDPXGYLAE

SEQ ID NO: 332112 - protein, 16 aa, Artificial Sequence
  Description of Artificial Sequence: Synthetic peptide
  Seed: LTFALQLHDPSGYLAE (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAE

SEQ ID NO: 332113 - protein, 17 aa, Artificial Sequence
  Description of Artificial Sequence: Synthetic peptide
  Seed: LTFALQLHDPSGYLAEA (PMEL_HUMAN)
  Core: FALQLHDPS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LTXALXLXDPXGYLAEA

SEQ ID NO: 332114 - protein, 17 aa, Artificial Sequence
  Description of Artificial Sequence: Synthetic peptide
  Seed: LTFALQLHDPSGYLAEA (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEA

SEQ ID NO: 332115 - protein, 17 aa, Artificial Sequence
  Description of Artificial Sequence: Synthetic peptide
  Seed: LTFALQLHDPSGYLAEA (PMEL_HUMAN)
  Core: LHDPSGYLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQXHDXSXYLXEA

SEQ ID NO: 332116 - protein, 18 aa, Artificial Sequence
  Description of Artificial Sequence: Synthetic peptide
  Seed: LTFALQLHDPSGYLAEAD (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAX

SEQ ID NO: 332117 - protein, 19 aa, Artificial Sequence
  Description of Artificial Sequence: Synthetic peptide
  Seed: LTFALQLHDPSGYLAEADL (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADL

SEQ ID NO: 332118 - protein, 19 aa, Artificial Sequence
  Description of Artificial Sequence: Synthetic peptide
  Seed: LTFALQLHDPSGYLAEADL (PMEL_HUMAN)
  Core: LHDPSGYLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQXHDXSXYLXEADL

SEQ ID NO: 332119 - protein, 19 aa, Artificial Sequence
  Description of Artificial Sequence: Synthetic peptide
  Seed: LTFALQLHDPSGYLAEADL (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXL

SEQ ID NO: 332120 - protein, 20 aa, Artificial Sequence
  Description of Artificial Sequence: Synthetic peptide
  Seed: LTFALQLHDPSGYLAEADLS (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADLS

SEQ ID NO: 332121 - protein, 20 aa, Artificial Sequence
  Description of Artificial Sequence: Synthetic peptide
  Seed: LTFALQLHDPSGYLAEADLS (PMEL_HUMAN)
  Core: LHDPSGYLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQXHDXSXYLXEADLS

SEQ ID NO: 332122 - protein, 20 aa, Artificial Sequence
  Description of Artificial Sequence: Synthetic peptide
  Seed: LTFALQLHDPSGYLAEADLS (PMEL_HUMAN)
  Core: HDPSGYLAE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLXDPXGXLAXADLS

SEQ ID NO: 332123 - protein, 20 aa, Artificial Sequence
  Description of Artificial Sequence: Synthetic peptide
  Seed: LTFALQLHDPSGYLAEADLS (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXLS

SEQ ID NO: 332124 - protein, 21 aa, Artificial Sequence
  Description of Artificial Sequence: Synthetic peptide
  Seed: LTFALQLHDPSGYLAEADLSY (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADLSY

SEQ ID NO: 332125 - protein, 21 aa, Artificial Sequence
  Description of Artificial Sequence: Synthetic peptide
  Seed: LTFALQLHDPSGYLAEADLSY (PMEL_HUMAN)
  Core: LHDPSGYLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQXHDXSXYLXEADLSY

SEQ ID NO: 332126 - protein, 21 aa, Artificial Sequence
  Description of Artificial Sequence: Synthetic peptide
  Seed: LTFALQLHDPSGYLAEADLSY (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXLSY

SEQ ID NO: 332127 - protein, 21 aa, Artificial Sequence
  Description of Artificial Sequence: Synthetic peptide
  Seed: LTFALQLHDPSGYLAEADLSY (PMEL_HUMAN)
  Core: YLAEADLSY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDPSGXLAXAXLSX

SEQ ID NO: 332128 - protein, 22 aa, Artificial Sequence
  Description of Artificial Sequence: Synthetic peptide
  Seed: LTFALQLHDPSGYLAEADLSYT (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADLSYT

SEQ ID NO: 332129 - protein, 22 aa, Artificial Sequence
  Description of Artificial Sequence: Synthetic peptide
  Seed: LTFALQLHDPSGYLAEADLSYT (PMEL_HUMAN)
  Core: LHDPSGYLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQXHDXSXYLXEADLSYT

SEQ ID NO: 332130 - protein, 22 aa, Artificial Sequence
  Description of Artificial Sequence: Synthetic peptide
  Seed: LTFALQLHDPSGYLAEADLSYT (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXLSYT

SEQ ID NO: 332131 - protein, 22 aa, Artificial Sequence
  Description of Artificial Sequence: Synthetic peptide
  Seed: LTFALQLHDPSGYLAEADLSYT (PMEL_HUMAN)
  Core: YLAEADLSY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDPSGXLAXAXLSXT

SEQ ID NO: 332132 - protein, 23 aa, Artificial Sequence
  Description of Artificial Sequence: Synthetic peptide
  Seed: LTFALQLHDPSGYLAEADLSYTW (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADLSYTW

SEQ ID NO: 332133 - protein, 23 aa, Artificial Sequence
  Description of Artificial Sequence: Synthetic peptide
  Seed: LTFALQLHDPSGYLAEADLSYTW (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXLSYTW

SEQ ID NO: 332134 - protein, 23 aa, Artificial Sequence
  Description of Artificial Sequence: Synthetic peptide
  Seed: LTFALQLHDPSGYLAEADLSYTW (PMEL_HUMAN)
  Core: YLAEADLSY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDPSGXLAXAXLSXTW

SEQ ID NO: 332135 - protein, 24 aa, Artificial Sequence
  Description of Artificial Sequence: Synthetic peptide
  Seed: LTFALQLHDPSGYLAEADLSYTWD (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADLSYTWD

SEQ ID NO: 332136 - protein, 24 aa, Artificial Sequence
  Description of Artificial Sequence: Synthetic peptide
  Seed: LTFALQLHDPSGYLAEADLSYTWD (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXLSYTWD

SEQ ID NO: 332137 - protein, 24 aa, Artificial Sequence
  Description of Artificial Sequence: Synthetic peptide
  Seed: LTFALQLHDPSGYLAEADLSYTWD (PMEL_HUMAN)
  Core: YLAEADLSY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDPSGXLAXAXLSXTWD

SEQ ID NO: 332138 - protein, 25 aa, Artificial Sequence
  Description of Artificial Sequence: Synthetic peptide
  Seed: LTFALQLHDPSGYLAEADLSYTWDF (PMEL_HUMAN)
  Core: LQLHDPSGY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTFAXQLXDXSGXLAEADLSYTWDF

SEQ ID NO: 332139 - protein, 25 aa, Artificial Sequence
  Description of Artificial Sequence: Synthetic peptide
  Seed: LTFALQLHDPSGYLAEADLSYTWDF (PMEL_HUMAN)
  Core: PSGYLAEAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDXSGXLXEAXLSYTWDF

SEQ ID NO: 332140 - protein, 25 aa, Artificial Sequence
  Description of Artificial Sequence: Synthetic peptide
  Seed: LTFALQLHDPSGYLAEADLSYTWDF (PMEL_HUMAN)
  Core: YLAEADLSY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LTFALQLHDPSGXLAXAXLSXTWDF

SEQ ID NO: 332141 - protein, 14 aa, Artificial Sequence
  Description of Artificial Sequence: Synthetic peptide
  Seed: LTSCGSSPVPGTTD (PMEL_HUMAN)
  Core: CGSSPVPGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LTSXGSXPXPGXTD

SEQ ID NO: 332142 - protein, 15 aa, Artificial Sequence
  Description of Artificial Sequence: Synthetic peptide
  Seed: LTSCGSSPVPGTTDG (PMEL_HUMAN)
  Core: CGSSPVPGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LTSXGSXPXPGXTDG

SEQ ID NO: 332143 - protein, 16 aa, Artificial Sequence
  Description of Artificial Sequence: Synthetic peptide
  Seed: LTSCGSSPVPGTTDGH (PMEL_HUMAN)
  Core: CGSSPVPGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LTSXGSXPXPGXTDGH

SEQ ID NO: 332144 - protein, 17 aa, Artificial Sequence
  Description of Artificial Sequence: Synthetic peptide
  Seed: LTSCGSSPVPGTTDGHR (PMEL_HUMAN)
  Core: PVPGTTDGH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LTSCGSSXVPXTXDGXR

SEQ ID NO: 332145 - protein, 20 aa, Artificial Sequence
  Description of Artificial Sequence: Synthetic peptide
  Seed: LTSCGSSPVPGTTDGHRPTA (PMEL_HUMAN)
  Core: PVPGTTDGH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LTSCGSSXVPXTXDGXRPTA

SEQ ID NO: 332146 - protein, 13 aa, Artificial Sequence
  Description of Artificial Sequence: Synthetic peptide
  Seed: LTVSCQGGLPKEA (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEX

SEQ ID NO: 332147 - protein, 14 aa, Artificial Sequence
  Description of Artificial Sequence: Synthetic peptide
  Seed: LTVSCQGGLPKEAC (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXC

SEQ ID NO: 332148 - protein, 15 aa, Artificial Sequence
  Description of Artificial Sequence: Synthetic peptide
  Seed: LTVSCQGGLPKEACM (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCM

SEQ ID NO: 332149 - protein, 16 aa, Artificial Sequence
  Description of Artificial Sequence: Synthetic peptide
  Seed: LTVSCQGGLPKEACME (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCME

SEQ ID NO: 332150 - protein, 17 aa, Artificial Sequence
  Description of Artificial Sequence: Synthetic peptide
  Seed: LTVSCQGGLPKEACMEI (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEI

SEQ ID NO: 332151 - protein, 18 aa, Artificial Sequence
  Description of Artificial Sequence: Synthetic peptide
  Seed: LTVSCQGGLPKEACMEIS (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEIS

SEQ ID NO: 332152 - protein, 19 aa, Artificial Sequence
  Description of Artificial Sequence: Synthetic peptide
  Seed: LTVSCQGGLPKEACMEISS (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISS

SEQ ID NO: 332153 - protein, 20 aa, Artificial Sequence
  Description of Artificial Sequence: Synthetic peptide
  Seed: LTVSCQGGLPKEACMEISSP (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISSP

SEQ ID NO: 332154 - protein, 21 aa, Artificial Sequence
  Description of Artificial Sequence: Synthetic peptide
  Seed: LTVSCQGGLPKEACMEISSPG (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISSPG

SEQ ID NO: 332155 - protein, 22 aa, Artificial Sequence
  Description of Artificial Sequence: Synthetic peptide
  Seed: LTVSCQGGLPKEACMEISSPGC (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISSPGC

SEQ ID NO: 332156 - protein, 23 aa, Artificial Sequence
  Description of Artificial Sequence: Synthetic peptide
  Seed: LTVSCQGGLPKEACMEISSPGCQ (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISSPGCQ

SEQ ID NO: 332157 - protein, 24 aa, Artificial Sequence
  Description of Artificial Sequence: Synthetic peptide
  Seed: LTVSCQGGLPKEACMEISSPGCQP (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISSPGCQP

SEQ ID NO: 332158 - protein, 25 aa, Artificial Sequence
  Description of Artificial Sequence: Synthetic peptide
  Seed: LTVSCQGGLPKEACMEISSPGCQPP (PMEL_HUMAN)
  Core: CQGGLPKEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LTVSXQGXLXKEXCMEISSPGCQPP

SEQ ID NO: 332159 - protein, 14 aa, Artificial Sequence
  Description of Artificial Sequence: Synthetic peptide
  Seed: LVKRQVPLDCVLYR (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXR

SEQ ID NO: 332160 - protein, 15 aa, Artificial Sequence
  Description of Artificial Sequence: Synthetic peptide
  Seed: LVKRQVPLDCVLYRY (PMEL_HUMAN)
  Core: KRQVPLDCV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXRQXPXDCXLYRY

SEQ ID NO: 332161 - protein, 15 aa, Artificial Sequence
  Description of Artificial Sequence: Synthetic peptide
  Seed: LVKRQVPLDCVLYRY (PMEL_HUMAN)
  Core: RQVPLDCVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVKXQVXLXCVXYRY

SEQ ID NO: 332162 - protein, 15 aa, Artificial Sequence
  Description of Artificial Sequence: Synthetic peptide
  Seed: LVKRQVPLDCVLYRY (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRY

SEQ ID NO: 332163 - protein, 15 aa, Artificial Sequence
  Description of Artificial Sequence: Synthetic peptide
  Seed: LVKRQVPLDCVLYRY (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXY

SEQ ID NO: 332164 - protein, 16 aa, Artificial Sequence
  Description of Artificial Sequence: Synthetic peptide
  Seed: LVKRQVPLDCVLYRYG (PMEL_HUMAN)
  Core: KRQVPLDCV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXRQXPXDCXLYRYG

SEQ ID NO: 332165 - protein, 16 aa, Artificial Sequence
  Description of Artificial Sequence: Synthetic peptide
  Seed: LVKRQVPLDCVLYRYG (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRYG

SEQ ID NO: 332166 - protein, 16 aa, Artificial Sequence
  Description of Artificial Sequence: Synthetic peptide
  Seed: LVKRQVPLDCVLYRYG (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYG

SEQ ID NO: 332167 - protein, 16 aa, Artificial Sequence
  Description of Artificial Sequence: Synthetic peptide
  Seed: LVKRQVPLDCVLYRYG (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYX

SEQ ID NO: 332168 - protein, 17 aa, Artificial Sequence
  Description of Artificial Sequence: Synthetic peptide
  Seed: LVKRQVPLDCVLYRYGS (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRYGS

SEQ ID NO: 332169 - protein, 17 aa, Artificial Sequence
  Description of Artificial Sequence: Synthetic peptide
  Seed: LVKRQVPLDCVLYRYGS (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGS

SEQ ID NO: 332170 - protein, 17 aa, Artificial Sequence
  Description of Artificial Sequence: Synthetic peptide
  Seed: LVKRQVPLDCVLYRYGS (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXS

SEQ ID NO: 332171 - protein, 18 aa, Artificial Sequence
  Description of Artificial Sequence: Synthetic peptide
  Seed: LVKRQVPLDCVLYRYGSF (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSF

SEQ ID NO: 332172 - protein, 19 aa, Artificial Sequence
  Description of Artificial Sequence: Synthetic peptide
  Seed: LVKRQVPLDCVLYRYGSFS (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRYGSFS

SEQ ID NO: 332173 - protein, 19 aa, Artificial Sequence
  Description of Artificial Sequence: Synthetic peptide
  Seed: LVKRQVPLDCVLYRYGSFS (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFS

SEQ ID NO: 332174 - protein, 19 aa, Artificial Sequence
  Description of Artificial Sequence: Synthetic peptide
  Seed: LVKRQVPLDCVLYRYGSFS (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFS

SEQ ID NO: 332175 - protein, 20 aa, Artificial Sequence
  Description of Artificial Sequence: Synthetic peptide
  Seed: LVKRQVPLDCVLYRYGSFSV (PMEL_HUMAN)
  Core: RQVPLDCVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVKXQVXLXCVXYRYGSFSV

SEQ ID NO: 332176 - protein, 20 aa, Artificial Sequence
  Description of Artificial Sequence: Synthetic peptide
  Seed: LVKRQVPLDCVLYRYGSFSV (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRYGSFSV

SEQ ID NO: 332177 - protein, 20 aa, Artificial Sequence
  Description of Artificial Sequence: Synthetic peptide
  Seed: LVKRQVPLDCVLYRYGSFSV (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFSV

SEQ ID NO: 332178 - protein, 20 aa, Artificial Sequence
  Description of Artificial Sequence: Synthetic peptide
  Seed: LVKRQVPLDCVLYRYGSFSV (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFSV

SEQ ID NO: 332179 - protein, 20 aa, Artificial Sequence
  Description of Artificial Sequence: Synthetic peptide
  Seed: LVKRQVPLDCVLYRYGSFSV (PMEL_HUMAN)
  Core: CVLYRYGSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDXVLXRXGSXSV

SEQ ID NO: 332180 - protein, 20 aa, Artificial Sequence
  Description of Artificial Sequence: Synthetic peptide
  Seed: LVKRQVPLDCVLYRYGSFSV (PMEL_HUMAN)
  Core: LYRYGSFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVXYRXGXFSX

SEQ ID NO: 332181 - protein, 21 aa, Artificial Sequence
  Description of Artificial Sequence: Synthetic peptide
  Seed: LVKRQVPLDCVLYRYGSFSVT (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRYGSFSVT

SEQ ID NO: 332182 - protein, 21 aa, Artificial Sequence
  Description of Artificial Sequence: Synthetic peptide
  Seed: LVKRQVPLDCVLYRYGSFSVT (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFSVT

SEQ ID NO: 332183 - protein, 21 aa, Artificial Sequence
  Description of Artificial Sequence: Synthetic peptide
  Seed: LVKRQVPLDCVLYRYGSFSVT (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFSVT

SEQ ID NO: 332184 - protein, 21 aa, Artificial Sequence
  Description of Artificial Sequence: Synthetic peptide
  Seed: LVKRQVPLDCVLYRYGSFSVT (PMEL_HUMAN)
  Core: CVLYRYGSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDXVLXRXGSXSVT

SEQ ID NO: 332185 - protein, 21 aa, Artificial Sequence
  Description of Artificial Sequence: Synthetic peptide
  Seed: LVKRQVPLDCVLYRYGSFSVT (PMEL_HUMAN)
  Core: LYRYGSFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVXYRXGXFSXT

SEQ ID NO: 332186 - protein, 21 aa, Artificial Sequence
  Description of Artificial Sequence: Synthetic peptide
  Seed: LVKRQVPLDCVLYRYGSFSVT (PMEL_HUMAN)
  Core: YRYGSFSVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLXRYXSXSVX

SEQ ID NO: 332187 - protein, 22 aa, Artificial Sequence
  Description of Artificial Sequence: Synthetic peptide
  Seed: LVKRQVPLDCVLYRYGSFSVTL (PMEL_HUMAN)
  Core: QVPLDCVLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVKRXVPXDXVLXRYGSFSVTL

SEQ ID NO: 332188 - protein, 22 aa, Artificial Sequence
  Description of Artificial Sequence: Synthetic peptide
  Seed: LVKRQVPLDCVLYRYGSFSVTL (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFSVTL

SEQ ID NO: 332189 - protein, 22 aa, Artificial Sequence
  Description of Artificial Sequence: Synthetic peptide
  Seed: LVKRQVPLDCVLYRYGSFSVTL (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFSVTL

SEQ ID NO: 332190 - protein, 22 aa, Artificial Sequence
  Description of Artificial Sequence: Synthetic peptide
  Seed: LVKRQVPLDCVLYRYGSFSVTL (PMEL_HUMAN)
  Core: CVLYRYGSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDXVLXRXGSXSVTL

SEQ ID NO: 332191 - protein, 22 aa, Artificial Sequence
  Description of Artificial Sequence: Synthetic peptide
  Seed: LVKRQVPLDCVLYRYGSFSVTL (PMEL_HUMAN)
  Core: LYRYGSFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVXYRXGXFSXTL

SEQ ID NO: 332192 - protein, 22 aa, Artificial Sequence
  Description of Artificial Sequence: Synthetic peptide
  Seed: LVKRQVPLDCVLYRYGSFSVTL (PMEL_HUMAN)
  Core: YRYGSFSVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLXRYXSXSVXL

SEQ ID NO: 332193 - protein, 23 aa, Artificial Sequence
  Description of Artificial Sequence: Synthetic peptide
  Seed: LVKRQVPLDCVLYRYGSFSVTLD (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFSVTLD

SEQ ID NO: 332194 - protein, 23 aa, Artificial Sequence
  Description of Artificial Sequence: Synthetic peptide
  Seed: LVKRQVPLDCVLYRYGSFSVTLD (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFSVTLD

SEQ ID NO: 332195 - protein, 23 aa, Artificial Sequence
  Description of Artificial Sequence: Synthetic peptide
  Seed: LVKRQVPLDCVLYRYGSFSVTLD (PMEL_HUMAN)
  Core: LYRYGSFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVXYRXGXFSXTLD

SEQ ID NO: 332196 - protein, 23 aa, Artificial Sequence
  Description of Artificial Sequence: Synthetic peptide
  Seed: LVKRQVPLDCVLYRYGSFSVTLD (PMEL_HUMAN)
  Core: YRYGSFSVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLXRYXSXSVXLD

SEQ ID NO: 332197 - protein, 23 aa, Artificial Sequence
  Description of Artificial Sequence: Synthetic peptide
  Seed: LVKRQVPLDCVLYRYGSFSVTLD (PMEL_HUMAN)
  Core: RYGSFSVTL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLYXYGXFXVTXD

SEQ ID NO: 332198 - protein, 23 aa, Artificial Sequence
  Description of Artificial Sequence: Synthetic peptide
  Seed: LVKRQVPLDCVLYRYGSFSVTLD (PMEL_HUMAN)
  Core: YGSFSVTLD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLYRXGSXSXTLX

SEQ ID NO: 332199 - protein, 24 aa, Artificial Sequence
  Description of Artificial Sequence: Synthetic peptide
  Seed: LVKRQVPLDCVLYRYGSFSVTLDI (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFSVTLDI

SEQ ID NO: 332200 - protein, 24 aa, Artificial Sequence
  Description of Artificial Sequence: Synthetic peptide
  Seed: LVKRQVPLDCVLYRYGSFSVTLDI (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFSVTLDI

SEQ ID NO: 332201 - protein, 24 aa, Artificial Sequence
  Description of Artificial Sequence: Synthetic peptide
  Seed: LVKRQVPLDCVLYRYGSFSVTLDI (PMEL_HUMAN)
  Core: LYRYGSFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVXYRXGXFSXTLDI

SEQ ID NO: 332202 - protein, 24 aa, Artificial Sequence
  Description of Artificial Sequence: Synthetic peptide
  Seed: LVKRQVPLDCVLYRYGSFSVTLDI (PMEL_HUMAN)
  Core: YRYGSFSVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLXRYXSXSVXLDI

SEQ ID NO: 332203 - protein, 24 aa, Artificial Sequence
  Description of Artificial Sequence: Synthetic peptide
  Seed: LVKRQVPLDCVLYRYGSFSVTLDI (PMEL_HUMAN)
  Core: RYGSFSVTL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLYXYGXFXVTXDI

SEQ ID NO: 332204 - protein, 24 aa, Artificial Sequence
  Description of Artificial Sequence: Synthetic peptide
  Seed: LVKRQVPLDCVLYRYGSFSVTLDI (PMEL_HUMAN)
  Core: YGSFSVTLD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLYRXGSXSXTLXI

SEQ ID NO: 332205 - protein, 25 aa, Artificial Sequence
  Description of Artificial Sequence: Synthetic peptide
  Seed: LVKRQVPLDCVLYRYGSFSVTLDIV (PMEL_HUMAN)
  Core: VPLDCVLYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQXPLXCXLYXYGSFSVTLDIV

SEQ ID NO: 332206 - protein, 25 aa, Artificial Sequence
  Description of Artificial Sequence: Synthetic peptide
  Seed: LVKRQVPLDCVLYRYGSFSVTLDIV (PMEL_HUMAN)
  Core: LDCVLYRYG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPXDCXLXRYXSFSVTLDIV

SEQ ID NO: 332207 - protein, 25 aa, Artificial Sequence
  Description of Artificial Sequence: Synthetic peptide
  Seed: LVKRQVPLDCVLYRYGSFSVTLDIV (PMEL_HUMAN)
  Core: LYRYGSFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVXYRXGXFSXTLDIV

SEQ ID NO: 332208 - protein, 25 aa, Artificial Sequence
  Description of Artificial Sequence: Synthetic peptide
  Seed: LVKRQVPLDCVLYRYGSFSVTLDIV (PMEL_HUMAN)
  Core: YRYGSFSVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLXRYXSXSVXLDIV

SEQ ID NO: 332209 - protein, 25 aa, Artificial Sequence
  Description of Artificial Sequence: Synthetic peptide
  Seed: LVKRQVPLDCVLYRYGSFSVTLDIV (PMEL_HUMAN)
  Core: RYGSFSVTL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLYXYGXFXVTXDIV

SEQ ID NO: 332210 - protein, 25 aa, Artificial Sequence
  Description of Artificial Sequence: Synthetic peptide
  Seed: LVKRQVPLDCVLYRYGSFSVTLDIV (PMEL_HUMAN)
  Core: YGSFSVTLD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LVKRQVPLDCVLYRXGSXSXTLXIV

SEQ ID NO: 332211 - protein, 13 aa, Artificial Sequence
  Description of Artificial Sequence: Synthetic peptide
  Seed: LVLHQILKGGSGT (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGT

SEQ ID NO: 332212 - protein, 14 aa, Artificial Sequence
  Description of Artificial Sequence: Synthetic peptide
  Seed: LVLHQILKGGSGTY (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTY

SEQ ID NO: 332213 - protein, 15 aa, Artificial Sequence
  Description of Artificial Sequence: Synthetic peptide
  Seed: LVLHQILKGGSGTYC (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYC

SEQ ID NO: 332214 - protein, 15 aa, Artificial Sequence
  Description of Artificial Sequence: Synthetic peptide
  Seed: LVLHQILKGGSGTYC (PMEL_HUMAN)
  Core: HQILKGGSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXQIXKXGSXTYC

SEQ ID NO: 332215 - protein, 16 aa, Artificial Sequence
  Description of Artificial Sequence: Synthetic peptide
  Seed: LVLHQILKGGSGTYCL (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCL

SEQ ID NO: 332216 - protein, 16 aa, Artificial Sequence
  Description of Artificial Sequence: Synthetic peptide
  Seed: LVLHQILKGGSGTYCL (PMEL_HUMAN)
  Core: LKGGSGTYC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQIXKGXSXTYXL

SEQ ID NO: 332217 - protein, 17 aa, Artificial Sequence
  Description of Artificial Sequence: Synthetic peptide
  Seed: LVLHQILKGGSGTYCLN (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLN

SEQ ID NO: 332218 - protein, 17 aa, Artificial Sequence
  Description of Artificial Sequence: Synthetic peptide
  Seed: LVLHQILKGGSGTYCLN (PMEL_HUMAN)
  Core: LKGGSGTYC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQIXKGXSXTYXLN

SEQ ID NO: 332219 - protein, 18 aa, Artificial Sequence
  Description of Artificial Sequence: Synthetic peptide
  Seed: LVLHQILKGGSGTYCLNV (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNV

SEQ ID NO: 332220 - protein, 19 aa, Artificial Sequence
  Description of Artificial Sequence: Synthetic peptide
  Seed: LVLHQILKGGSGTYCLNVS (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVS

SEQ ID NO: 332221 - protein, 19 aa, Artificial Sequence
  Description of Artificial Sequence: Synthetic peptide
  Seed: LVLHQILKGGSGTYCLNVS (PMEL_HUMAN)
  Core: LKGGSGTYC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQIXKGXSXTYXLNVS

SEQ ID NO: 332222 - protein, 20 aa, Artificial Sequence
  Description of Artificial Sequence: Synthetic peptide
  Seed: LVLHQILKGGSGTYCLNVSL (PMEL_HUMAN)
  Core: LVLHQILKG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XVLXQXLKXGSGTYCLNVSL

SEQ ID NO: 332223 - protein, 20 aa, Artificial Sequence
  Description of Artificial Sequence: Synthetic peptide
  Seed: LVLHQILKGGSGTYCLNVSL (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVSL

SEQ ID NO: 332224 - protein, 20 aa, Artificial Sequence
  Description of Artificial Sequence: Synthetic peptide
  Seed: LVLHQILKGGSGTYCLNVSL (PMEL_HUMAN)
  Core: LKGGSGTYC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQIXKGXSXTYXLNVSL

SEQ ID NO: 332225 - protein, 21 aa, Artificial Sequence
  Description of Artificial Sequence: Synthetic peptide
  Seed: LVLHQILKGGSGTYCLNVSLA (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVSLA

SEQ ID NO: 332226 - protein, 21 aa, Artificial Sequence
  Description of Artificial Sequence: Synthetic peptide
  Seed: LVLHQILKGGSGTYCLNVSLA (PMEL_HUMAN)
  Core: SGTYCLNVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGXGTXCXNVXLA

SEQ ID NO: 332227 - protein, 22 aa, Artificial Sequence
  Description of Artificial Sequence: Synthetic peptide
  Seed: LVLHQILKGGSGTYCLNVSLAD (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVSLAD

SEQ ID NO: 332228 - protein, 22 aa, Artificial Sequence
  Description of Artificial Sequence: Synthetic peptide
  Seed: LVLHQILKGGSGTYCLNVSLAD (PMEL_HUMAN)
  Core: SGTYCLNVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGXGTXCXNVXLAD

SEQ ID NO: 332229 - protein, 23 aa, Artificial Sequence
  Description of Artificial Sequence: Synthetic peptide
  Seed: LVLHQILKGGSGTYCLNVSLADT (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVSLADT

SEQ ID NO: 332230 - protein, 23 aa, Artificial Sequence
  Description of Artificial Sequence: Synthetic peptide
  Seed: LVLHQILKGGSGTYCLNVSLADT (PMEL_HUMAN)
  Core: LKGGSGTYC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQIXKGXSXTYXLNVSLADT

SEQ ID NO: 332231 - protein, 23 aa, Artificial Sequence
  Description of Artificial Sequence: Synthetic peptide
  Seed: LVLHQILKGGSGTYCLNVSLADT (PMEL_HUMAN)
  Core: SGTYCLNVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGXGTXCXNVXLADT

SEQ ID NO: 332232 - protein, 23 aa, Artificial Sequence
  Description of Artificial Sequence: Synthetic peptide
  Seed: LVLHQILKGGSGTYCLNVSLADT (PMEL_HUMAN)
  Core: YCLNVSLAD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGSGTXCLXVXLAXT

SEQ ID NO: 332233 - protein, 24 aa, Artificial Sequence
  Description of Artificial Sequence: Synthetic peptide
  Seed: LVLHQILKGGSGTYCLNVSLADTN (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVSLADTN

SEQ ID NO: 332234 - protein, 24 aa, Artificial Sequence
  Description of Artificial Sequence: Synthetic peptide
  Seed: LVLHQILKGGSGTYCLNVSLADTN (PMEL_HUMAN)
  Core: SGTYCLNVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGXGTXCXNVXLADTN

SEQ ID NO: 332235 - protein, 24 aa, Artificial Sequence
  Description of Artificial Sequence: Synthetic peptide
  Seed: LVLHQILKGGSGTYCLNVSLADTN (PMEL_HUMAN)
  Core: TYCLNVSLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGSGXYCXNXSLXDTN

SEQ ID NO: 332236 - protein, 24 aa, Artificial Sequence
  Description of Artificial Sequence: Synthetic peptide
  Seed: LVLHQILKGGSGTYCLNVSLADTN (PMEL_HUMAN)
  Core: YCLNVSLAD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGSGTXCLXVXLAXTN

SEQ ID NO: 332237 - protein, 25 aa, Artificial Sequence
  Description of Artificial Sequence: Synthetic peptide
  Seed: LVLHQILKGGSGTYCLNVSLADTNS (PMEL_HUMAN)
  Core: LHQILKGGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXHQXLXGGXGTYCLNVSLADTNS

SEQ ID NO: 332238 - protein, 25 aa, Artificial Sequence
  Description of Artificial Sequence: Synthetic peptide
  Seed: LVLHQILKGGSGTYCLNVSLADTNS (PMEL_HUMAN)
  Core: TYCLNVSLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGSGXYCXNXSLXDTNS

SEQ ID NO: 332239 - protein, 25 aa, Artificial Sequence
  Description of Artificial Sequence: Synthetic peptide
  Seed: LVLHQILKGGSGTYCLNVSLADTNS (PMEL_HUMAN)
  Core: YCLNVSLAD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVLHQILKGGSGTXCLXVXLAXTNS

SEQ ID NO: 332240 - protein, 13 aa, Artificial Sequence
  Description of Artificial Sequence: Synthetic peptide
  Seed: LVLKRCLLHLAVI (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVI

SEQ ID NO: 332241 - protein, 14 aa, Artificial Sequence
  Description of Artificial Sequence: Synthetic peptide
  Seed: LVLKRCLLHLAVIG (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIG

SEQ ID NO: 332242 - protein, 14 aa, Artificial Sequence
  Description of Artificial Sequence: Synthetic peptide
  Seed: LVLKRCLLHLAVIG (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIG

SEQ ID NO: 332243 - protein, 14 aa, Artificial Sequence
  Description of Artificial Sequence: Synthetic peptide
  Seed: LVLKRCLLHLAVIG (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXG

SEQ ID NO: 332244 - protein, 15 aa, Artificial Sequence
  Description of Artificial Sequence: Synthetic peptide
  Seed: LVLKRCLLHLAVIGA (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIGA

SEQ ID NO: 332245 - protein, 15 aa, Artificial Sequence
  Description of Artificial Sequence: Synthetic peptide
  Seed: LVLKRCLLHLAVIGA (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIGA

SEQ ID NO: 332246 - protein, 15 aa, Artificial Sequence
  Description of Artificial Sequence: Synthetic peptide
  Seed: LVLKRCLLHLAVIGA (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGA

SEQ ID NO: 332247 - protein, 15 aa, Artificial Sequence
  Description of Artificial Sequence: Synthetic peptide
  Seed: LVLKRCLLHLAVIGA (PMEL_HUMAN)
  Core: CLLHLAVIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRXLLXLXVIXA

SEQ ID NO: 332248 - protein, 15 aa, Artificial Sequence
  Description of Artificial Sequence: Synthetic peptide
  Seed: LVLKRCLLHLAVIGA (PMEL_HUMAN)
  Core: LLHLAVIGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCXLHXAXIGX

SEQ ID NO: 332249 - protein, 16 aa, Artificial Sequence
  Description of Artificial Sequence: Synthetic peptide
  Seed: LVLKRCLLHLAVIGAL (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIGAL

SEQ ID NO: 332250 - protein, 16 aa, Artificial Sequence
  Description of Artificial Sequence: Synthetic peptide
  Seed: LVLKRCLLHLAVIGAL (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIGAL

SEQ ID NO: 332251 - protein, 16 aa, Artificial Sequence
  Description of Artificial Sequence: Synthetic peptide
  Seed: LVLKRCLLHLAVIGAL (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGAL

SEQ ID NO: 332252 - protein, 16 aa, Artificial Sequence
  Description of Artificial Sequence: Synthetic peptide
  Seed: LVLKRCLLHLAVIGAL (PMEL_HUMAN)
  Core: CLLHLAVIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRXLLXLXVIXAL

SEQ ID NO: 332253 - protein, 16 aa, Artificial Sequence
  Description of Artificial Sequence: Synthetic peptide
  Seed: LVLKRCLLHLAVIGAL (PMEL_HUMAN)
  Core: LLHLAVIGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCXLHXAXIGXL

SEQ ID NO: 332254 - protein, 16 aa, Artificial Sequence
  Description of Artificial Sequence: Synthetic peptide
  Seed: LVLKRCLLHLAVIGAL (PMEL_HUMAN)
  Core: LHLAVIGAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLXHLXVXGAX

SEQ ID NO: 332255 - protein, 17 aa, Artificial Sequence
  Description of Artificial Sequence: Synthetic peptide
  Seed: LVLKRCLLHLAVIGALL (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIGALL

SEQ ID NO: 332256 - protein, 17 aa, Artificial Sequence
  Description of Artificial Sequence: Synthetic peptide
  Seed: LVLKRCLLHLAVIGALL (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIGALL

SEQ ID NO: 332257 - protein, 17 aa, Artificial Sequence
  Description of Artificial Sequence: Synthetic peptide
  Seed: LVLKRCLLHLAVIGALL (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGALL

SEQ ID NO: 332258 - protein, 17 aa, Artificial Sequence
  Description of Artificial Sequence: Synthetic peptide
  Seed: LVLKRCLLHLAVIGALL (PMEL_HUMAN)
  Core: CLLHLAVIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRXLLXLXVIXALL

SEQ ID NO: 332259 - protein, 17 aa, Artificial Sequence
  Description of Artificial Sequence: Synthetic peptide
  Seed: LVLKRCLLHLAVIGALL (PMEL_HUMAN)
  Core: LLHLAVIGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCXLHXAXIGXLL

SEQ ID NO: 332260 - protein, 17 aa, Artificial Sequence
  Description of Artificial Sequence: Synthetic peptide
  Seed: LVLKRCLLHLAVIGALL (PMEL_HUMAN)
  Core: LHLAVIGAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLXHLXVXGAXL

SEQ ID NO: 332261 - protein, 18 aa, Artificial Sequence
  Description of Artificial Sequence: Synthetic peptide
  Seed: LVLKRCLLHLAVIGALLA (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIGALLA

SEQ ID NO: 332262 - protein, 18 aa, Artificial Sequence
  Description of Artificial Sequence: Synthetic peptide
  Seed: LVLKRCLLHLAVIGALLA (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIGALLA

SEQ ID NO: 332263 - protein, 18 aa, Artificial Sequence
  Description of Artificial Sequence: Synthetic peptide
  Seed: LVLKRCLLHLAVIGALLA (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGALLA

SEQ ID NO: 332264 - protein, 18 aa, Artificial Sequence
  Description of Artificial Sequence: Synthetic peptide
  Seed: LVLKRCLLHLAVIGALLA (PMEL_HUMAN)
  Core: LLHLAVIGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCXLHXAXIGXLLA

SEQ ID NO: 332265 - protein, 18 aa, Artificial Sequence
  Description of Artificial Sequence: Synthetic peptide
  Seed: LVLKRCLLHLAVIGALLA (PMEL_HUMAN)
  Core: LHLAVIGAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLXHLXVXGAXLA

SEQ ID NO: 332266 - protein, 19 aa, Artificial Sequence
  Description of Artificial Sequence: Synthetic peptide
  Seed: LVLKRCLLHLAVIGALLAV (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIGALLAV

SEQ ID NO: 332267 - protein, 19 aa, Artificial Sequence
  Description of Artificial Sequence: Synthetic peptide
  Seed: LVLKRCLLHLAVIGALLAV (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIGALLAV

SEQ ID NO: 332268 - protein, 19 aa, Artificial Sequence
  Description of Artificial Sequence: Synthetic peptide
  Seed: LVLKRCLLHLAVIGALLAV (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGALLAV

SEQ ID NO: 332269 - protein, 19 aa, Artificial Sequence
  Description of Artificial Sequence: Synthetic peptide
  Seed: LVLKRCLLHLAVIGALLAV (PMEL_HUMAN)
  Core: CLLHLAVIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRXLLXLXVIXALLAV

SEQ ID NO: 332270 - protein, 19 aa, Artificial Sequence
  Description of Artificial Sequence: Synthetic peptide
  Seed: LVLKRCLLHLAVIGALLAV (PMEL_HUMAN)
  Core: LLHLAVIGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCXLHXAXIGXLLAV

SEQ ID NO: 332271 - protein, 19 aa, Artificial Sequence
  Description of Artificial Sequence: Synthetic peptide
  Seed: LVLKRCLLHLAVIGALLAV (PMEL_HUMAN)
  Core: LHLAVIGAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLXHLXVXGAXLAV

SEQ ID NO: 332272 - protein, 19 aa, Artificial Sequence
  Description of Artificial Sequence: Synthetic peptide
  Seed: LVLKRCLLHLAVIGALLAV (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXV

SEQ ID NO: 332273 - protein, 20 aa, Artificial Sequence
  Description of Artificial Sequence: Synthetic peptide
  Seed: LVLKRCLLHLAVIGALLAVG (PMEL_HUMAN)
  Core: LKRCLLHLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXKRXLXHLXVIGALLAVG

SEQ ID NO: 332274 - protein, 20 aa, Artificial Sequence
  Description of Artificial Sequence: Synthetic peptide
  Seed: LVLKRCLLHLAVIGALLAVG (PMEL_HUMAN)
  Core: KRCLLHLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXRCXLXLAXIGALLAVG

SEQ ID NO: 332275 - protein, 20 aa, Artificial Sequence
  Description of Artificial Sequence: Synthetic peptide
  Seed: LVLKRCLLHLAVIGALLAVG (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGALLAVG

SEQ ID NO: 332276 - protein, 20 aa, Artificial Sequence
  Description of Artificial Sequence: Synthetic peptide
  Seed: LVLKRCLLHLAVIGALLAVG (PMEL_HUMAN)
  Core: CLLHLAVIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRXLLXLXVIXALLAVG

SEQ ID NO: 332277 - protein, 20 aa, Artificial Sequence
  Description of Artificial Sequence: Synthetic peptide
  Seed: LVLKRCLLHLAVIGALLAVG (PMEL_HUMAN)
  Core: LLHLAVIGA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCXLHXAXIGXLLAVG

SEQ ID NO: 332278 - protein, 20 aa, Artificial Sequence
  Description of Artificial Sequence: Synthetic peptide
  Seed: LVLKRCLLHLAVIGALLAVG (PMEL_HUMAN)
  Core: LHLAVIGAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLXHLXVXGAXLAVG

SEQ ID NO: 332279 - protein, 20 aa, Artificial Sequence
  Description of Artificial Sequence: Synthetic peptide
  Seed: LVLKRCLLHLAVIGALLAVG (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXVG

SEQ ID NO: 332280 - protein, 20 aa, Artificial Sequence
  Description of Artificial Sequence: Synthetic peptide
  Seed: LVLKRCLLHLAVIGALLAVG (PMEL_HUMAN)
  Core: VIGALLAVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAXIGXLXAVX

SEQ ID NO: 332281 - protein, 21 aa, Artificial Sequence
  Description of Artificial Sequence: Synthetic peptide
  Seed: LVLKRCLLHLAVIGALLAVGA (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXVGA

SEQ ID NO: 332282 - protein, 21 aa, Artificial Sequence
  Description of Artificial Sequence: Synthetic peptide
  Seed: LVLKRCLLHLAVIGALLAVGA (PMEL_HUMAN)
  Core: VIGALLAVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAXIGXLXAVXA

SEQ ID NO: 332283 - protein, 22 aa, Artificial Sequence
  Description of Artificial Sequence: Synthetic peptide
  Seed: LVLKRCLLHLAVIGALLAVGAT (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXVGAT

SEQ ID NO: 332284 - protein, 22 aa, Artificial Sequence
  Description of Artificial Sequence: Synthetic peptide
  Seed: LVLKRCLLHLAVIGALLAVGAT (PMEL_HUMAN)
  Core: AVIGALLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLXVIXAXLAXGAT

SEQ ID NO: 332285 - protein, 22 aa, Artificial Sequence
  Description of Artificial Sequence: Synthetic peptide
  Seed: LVLKRCLLHLAVIGALLAVGAT (PMEL_HUMAN)
  Core: VIGALLAVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAXIGXLXAVXAT

SEQ ID NO: 332286 - protein, 22 aa, Artificial Sequence
  Description of Artificial Sequence: Synthetic peptide
  Seed: LVLKRCLLHLAVIGALLAVGAT (PMEL_HUMAN)
  Core: IGALLAVGA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAVXGAXLXVGXT

SEQ ID NO: 332287 - protein, 23 aa, Artificial Sequence
  Description of Artificial Sequence: Synthetic peptide
  Seed: LVLKRCLLHLAVIGALLAVGATK (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXVGATK

SEQ ID NO: 332288 - protein, 23 aa, Artificial Sequence
  Description of Artificial Sequence: Synthetic peptide
  Seed: LVLKRCLLHLAVIGALLAVGATK (PMEL_HUMAN)
  Core: VIGALLAVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAXIGXLXAVXATK

SEQ ID NO: 332289 - protein, 23 aa, Artificial Sequence
  Description of Artificial Sequence: Synthetic peptide
  Seed: LVLKRCLLHLAVIGALLAVGATK (PMEL_HUMAN)
  Core: IGALLAVGA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAVXGAXLXVGXTK

SEQ ID NO: 332290 - protein, 24 aa, Artificial Sequence
  Description of Artificial Sequence: Synthetic peptide
  Seed: LVLKRCLLHLAVIGALLAVGATKV (PMEL_HUMAN)
  Core: RCLLHLAVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLKXCLXHXAVXGALLAVGATKV

SEQ ID NO: 332291 - protein, 24 aa, Artificial Sequence
  Description of Artificial Sequence: Synthetic peptide
  Seed: LVLKRCLLHLAVIGALLAVGATKV (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXVGATKV

SEQ ID NO: 332292 - protein, 24 aa, Artificial Sequence
  Description of Artificial Sequence: Synthetic peptide
  Seed: LVLKRCLLHLAVIGALLAVGATKV (PMEL_HUMAN)
  Core: VIGALLAVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAXIGXLXAVXATKV

SEQ ID NO: 332293 - protein, 24 aa, Artificial Sequence
  Description of Artificial Sequence: Synthetic peptide
  Seed: LVLKRCLLHLAVIGALLAVGATKV (PMEL_HUMAN)
  Core: IGALLAVGA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAVXGAXLXVGXTKV

SEQ ID NO: 332294 - protein, 24 aa, Artificial Sequence
  Description of Artificial Sequence: Synthetic peptide
  Seed: LVLKRCLLHLAVIGALLAVGATKV (PMEL_HUMAN)
  Core: LLAVGATKV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAVIGAXLAXGXTKX

SEQ ID NO: 332295 - protein, 25 aa, Artificial Sequence
  Description of Artificial Sequence: Synthetic peptide
  Seed: LVLKRCLLHLAVIGALLAVGATKVP (PMEL_HUMAN)
  Core: LAVIGALLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHXAVXGXLLXVGATKVP

SEQ ID NO: 332296 - protein, 25 aa, Artificial Sequence
  Description of Artificial Sequence: Synthetic peptide
  Seed: LVLKRCLLHLAVIGALLAVGATKVP (PMEL_HUMAN)
  Core: VIGALLAVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAXIGXLXAVXATKVP

SEQ ID NO: 332297 - protein, 25 aa, Artificial Sequence
  Description of Artificial Sequence: Synthetic peptide
  Seed: LVLKRCLLHLAVIGALLAVGATKVP (PMEL_HUMAN)
  Core: IGALLAVGA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAVXGAXLXVGXTKVP

SEQ ID NO: 332298 - protein, 25 aa, Artificial Sequence
  Description of Artificial Sequence: Synthetic peptide
  Seed: LVLKRCLLHLAVIGALLAVGATKVP (PMEL_HUMAN)
  Core: LLAVGATKV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LVLKRCLLHLAVIGAXLAXGXTKXP

SEQ ID NO: 332299 - protein, 14 aa, Artificial Sequence
  Description of Artificial Sequence: Synthetic peptide
  Seed: LVLMAVVLASLIYR (PMEL_HUMAN)
  Core: LMAVVLASL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXMAXVXASXIYR

SEQ ID NO: 332300 - protein, 14 aa, Artificial Sequence
  Description of Artificial Sequence: Synthetic peptide
  Seed: LVLMAVVLASLIYR (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYR

SEQ ID NO: 332301 - protein, 15 aa, Artificial Sequence
  Description of Artificial Sequence: Synthetic peptide
  Seed: LVLMAVVLASLIYRR (PMEL_HUMAN)
  Core: LMAVVLASL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXMAXVXASXIYRR

SEQ ID NO: 332302 - protein, 15 aa, Artificial Sequence
  Description of Artificial Sequence: Synthetic peptide
  Seed: LVLMAVVLASLIYRR (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRR

SEQ ID NO: 332303 - protein, 15 aa, Artificial Sequence
  Description of Artificial Sequence: Synthetic peptide
  Seed: LVLMAVVLASLIYRR (PMEL_HUMAN)
  Core: AVVLASLIY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLMXVVXAXLIXRR

SEQ ID NO: 332304 - protein, 15 aa, Artificial Sequence
  Description of Artificial Sequence: Synthetic peptide
  Seed: LVLMAVVLASLIYRR (PMEL_HUMAN)
  Core: VVLASLIYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAXVLXSXIYXR

SEQ ID NO: 332305 - protein, 15 aa, Artificial Sequence
  Description of Artificial Sequence: Synthetic peptide
  Seed: LVLMAVVLASLIYRR (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRX

SEQ ID NO: 332306 - protein, 16 aa, Artificial Sequence
  Description of Artificial Sequence: Synthetic peptide
  Seed: LVLMAVVLASLIYRRR (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRR

SEQ ID NO: 332307 - protein, 16 aa, Artificial Sequence
  Description of Artificial Sequence: Synthetic peptide
  Seed: LVLMAVVLASLIYRRR (PMEL_HUMAN)
  Core: AVVLASLIY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLMXVVXAXLIXRRR

SEQ ID NO: 332308 - protein, 16 aa, Artificial Sequence
  Description of Artificial Sequence: Synthetic peptide
  Seed: LVLMAVVLASLIYRRR (PMEL_HUMAN)
  Core: VVLASLIYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAXVLXSXIYXRR

SEQ ID NO: 332309 - protein, 16 aa, Artificial Sequence
  Description of Artificial Sequence: Synthetic peptide
  Seed: LVLMAVVLASLIYRRR (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXR

SEQ ID NO: 332310 - protein, 16 aa, Artificial Sequence
  Description of Artificial Sequence: Synthetic peptide
  Seed: LVLMAVVLASLIYRRR (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRX

SEQ ID NO: 332311 - protein, 17 aa, Artificial Sequence
  Description of Artificial Sequence: Synthetic peptide
  Seed: LVLMAVVLASLIYRRRL (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRL

SEQ ID NO: 332312 - protein, 17 aa, Artificial Sequence
  Description of Artificial Sequence: Synthetic peptide
  Seed: LVLMAVVLASLIYRRRL (PMEL_HUMAN)
  Core: AVVLASLIY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLMXVVXAXLIXRRRL

SEQ ID NO: 332313 - protein, 17 aa, Artificial Sequence
  Description of Artificial Sequence: Synthetic peptide
  Seed: LVLMAVVLASLIYRRRL (PMEL_HUMAN)
  Core: VVLASLIYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAXVLXSXIYXRRL

SEQ ID NO: 332314 - protein, 17 aa, Artificial Sequence
  Description of Artificial Sequence: Synthetic peptide
  Seed: LVLMAVVLASLIYRRRL (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRL

SEQ ID NO: 332315 - protein, 17 aa, Artificial Sequence
  Description of Artificial Sequence: Synthetic peptide
  Seed: LVLMAVVLASLIYRRRL (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXL

SEQ ID NO: 332316 - protein, 18 aa, Artificial Sequence
  Description of Artificial Sequence: Synthetic peptide
  Seed: LVLMAVVLASLIYRRRLM (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLM

SEQ ID NO: 332317 - protein, 18 aa, Artificial Sequence
  Description of Artificial Sequence: Synthetic peptide
  Seed: LVLMAVVLASLIYRRRLM (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLM

SEQ ID NO: 332318 - protein, 18 aa, Artificial Sequence
  Description of Artificial Sequence: Synthetic peptide
  Seed: LVLMAVVLASLIYRRRLM (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLM

SEQ ID NO: 332319 - protein, 19 aa, Artificial Sequence
  Description of Artificial Sequence: Synthetic peptide
  Seed: LVLMAVVLASLIYRRRLMK (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMK

SEQ ID NO: 332320 - protein, 19 aa, Artificial Sequence
  Description of Artificial Sequence: Synthetic peptide
  Seed: LVLMAVVLASLIYRRRLMK (PMEL_HUMAN)
  Core: AVVLASLIY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLMXVVXAXLIXRRRLMK

SEQ ID NO: 332321 - protein, 19 aa, Artificial Sequence
  Description of Artificial Sequence: Synthetic peptide
  Seed: LVLMAVVLASLIYRRRLMK (PMEL_HUMAN)
  Core: VVLASLIYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAXVLXSXIYXRRLMK

SEQ ID NO: 332322 - protein, 19 aa, Artificial Sequence
  Description of Artificial Sequence: Synthetic peptide
  Seed: LVLMAVVLASLIYRRRLMK (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMK

SEQ ID NO: 332323 - protein, 19 aa, Artificial Sequence
  Description of Artificial Sequence: Synthetic peptide
  Seed: LVLMAVVLASLIYRRRLMK (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMK

SEQ ID NO: 332324 - protein, 19 aa, Artificial Sequence
  Description of Artificial Sequence: Synthetic peptide
  Seed: LVLMAVVLASLIYRRRLMK (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMK

SEQ ID NO: 332325 - protein, 19 aa, Artificial Sequence
  Description of Artificial Sequence: Synthetic peptide
  Seed: LVLMAVVLASLIYRRRLMK (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXK

SEQ ID NO: 332326 - protein, 20 aa, Artificial Sequence
  Description of Artificial Sequence: Synthetic peptide
  Seed: LVLMAVVLASLIYRRRLMKQ (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMKQ

SEQ ID NO: 332327 - protein, 20 aa, Artificial Sequence
  Description of Artificial Sequence: Synthetic peptide
  Seed: LVLMAVVLASLIYRRRLMKQ (PMEL_HUMAN)
  Core: AVVLASLIY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVLMXVVXAXLIXRRRLMKQ

SEQ ID NO: 332328 - protein, 20 aa, Artificial Sequence
  Description of Artificial Sequence: Synthetic peptide
  Seed: LVLMAVVLASLIYRRRLMKQ (PMEL_HUMAN)
  Core: VVLASLIYR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAXVLXSXIYXRRLMKQ

SEQ ID NO: 332329 - protein, 20 aa, Artificial Sequence
  Description of Artificial Sequence: Synthetic peptide
  Seed: LVLMAVVLASLIYRRRLMKQ (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMKQ

SEQ ID NO: 332330 - protein, 20 aa, Artificial Sequence
  Description of Artificial Sequence: Synthetic peptide
  Seed: LVLMAVVLASLIYRRRLMKQ (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMKQ

SEQ ID NO: 332331 - protein, 20 aa, Artificial Sequence
  Description of Artificial Sequence: Synthetic peptide
  Seed: LVLMAVVLASLIYRRRLMKQ (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMKQ

SEQ ID NO: 332332 - protein, 20 aa, Artificial Sequence
  Description of Artificial Sequence: Synthetic peptide
  Seed: LVLMAVVLASLIYRRRLMKQ (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXKQ

SEQ ID NO: 332333 - protein, 20 aa, Artificial Sequence
  Description of Artificial Sequence: Synthetic peptide
  Seed: LVLMAVVLASLIYRRRLMKQ (PMEL_HUMAN)
  Core: LIYRRRLMK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASXIYXRXLMXQ

SEQ ID NO: 332334 - protein, 21 aa, Artificial Sequence
  Description of Artificial Sequence: Synthetic peptide
  Seed: LVLMAVVLASLIYRRRLMKQD (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMKQD

SEQ ID NO: 332335 - protein, 21 aa, Artificial Sequence
  Description of Artificial Sequence: Synthetic peptide
  Seed: LVLMAVVLASLIYRRRLMKQD (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMKQD

SEQ ID NO: 332336 - protein, 21 aa, Artificial Sequence
  Description of Artificial Sequence: Synthetic peptide
  Seed: LVLMAVVLASLIYRRRLMKQD (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMKQD

SEQ ID NO: 332337 - protein, 21 aa, Artificial Sequence
  Description of Artificial Sequence: Synthetic peptide
  Seed: LVLMAVVLASLIYRRRLMKQD (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMKQD

SEQ ID NO: 332338 - protein, 21 aa, Artificial Sequence
  Description of Artificial Sequence: Synthetic peptide
  Seed: LVLMAVVLASLIYRRRLMKQD (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXKQD

SEQ ID NO: 332339 - protein, 21 aa, Artificial Sequence
  Description of Artificial Sequence: Synthetic peptide
  Seed: LVLMAVVLASLIYRRRLMKQD (PMEL_HUMAN)
  Core: LIYRRRLMK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASXIYXRXLMXQD

SEQ ID NO: 332340 - protein, 22 aa, Artificial Sequence
  Description of Artificial Sequence: Synthetic peptide
  Seed: LVLMAVVLASLIYRRRLMKQDF (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMKQDF

SEQ ID NO: 332341 - protein, 22 aa, Artificial Sequence
  Description of Artificial Sequence: Synthetic peptide
  Seed: LVLMAVVLASLIYRRRLMKQDF (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMKQDF

SEQ ID NO: 332342 - protein, 22 aa, Artificial Sequence
  Description of Artificial Sequence: Synthetic peptide
  Seed: LVLMAVVLASLIYRRRLMKQDF (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMKQDF

SEQ ID NO: 332343 - protein, 22 aa, Artificial Sequence
  Description of Artificial Sequence: Synthetic peptide
  Seed: LVLMAVVLASLIYRRRLMKQDF (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMKQDF

SEQ ID NO: 332344 - protein, 22 aa, Artificial Sequence
  Description of Artificial Sequence: Synthetic peptide
  Seed: LVLMAVVLASLIYRRRLMKQDF (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXKQDF

SEQ ID NO: 332345 - protein, 22 aa, Artificial Sequence
  Description of Artificial Sequence: Synthetic peptide
  Seed: LVLMAVVLASLIYRRRLMKQDF (PMEL_HUMAN)
  Core: LIYRRRLMK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASXIYXRXLMXQDF

SEQ ID NO: 332346 - protein, 22 aa, Artificial Sequence
  Description of Artificial Sequence: Synthetic peptide
  Seed: LVLMAVVLASLIYRRRLMKQDF (PMEL_HUMAN)
  Core: IYRRRLMKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLXYRXRXMKXDF

SEQ ID NO: 332347 - protein, 22 aa, Artificial Sequence
  Description of Artificial Sequence: Synthetic peptide
  Seed: LVLMAVVLASLIYRRRLMKQDF (PMEL_HUMAN)
  Core: YRRRLMKQD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIXRRXLXKQXF

SEQ ID NO: 332348 - protein, 23 aa, Artificial Sequence
  Description of Artificial Sequence: Synthetic peptide
  Seed: LVLMAVVLASLIYRRRLMKQDFS (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMKQDFS

SEQ ID NO: 332349 - protein, 23 aa, Artificial Sequence
  Description of Artificial Sequence: Synthetic peptide
  Seed: LVLMAVVLASLIYRRRLMKQDFS (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMKQDFS

SEQ ID NO: 332350 - protein, 23 aa, Artificial Sequence
  Description of Artificial Sequence: Synthetic peptide
  Seed: LVLMAVVLASLIYRRRLMKQDFS (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMKQDFS

SEQ ID NO: 332351 - protein, 23 aa, Artificial Sequence
  Description of Artificial Sequence: Synthetic peptide
  Seed: LVLMAVVLASLIYRRRLMKQDFS (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMKQDFS

SEQ ID NO: 332352 - protein, 23 aa, Artificial Sequence
  Description of Artificial Sequence: Synthetic peptide
  Seed: LVLMAVVLASLIYRRRLMKQDFS (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXKQDFS

SEQ ID NO: 332353 - protein, 23 aa, Artificial Sequence
  Description of Artificial Sequence: Synthetic peptide
  Seed: LVLMAVVLASLIYRRRLMKQDFS (PMEL_HUMAN)
  Core: LIYRRRLMK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASXIYXRXLMXQDFS

SEQ ID NO: 332354 - protein, 23 aa, Artificial Sequence
  Description of Artificial Sequence: Synthetic peptide
  Seed: LVLMAVVLASLIYRRRLMKQDFS (PMEL_HUMAN)
  Core: IYRRRLMKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLXYRXRXMKXDFS

SEQ ID NO: 332355 - protein, 23 aa, Artificial Sequence
  Description of Artificial Sequence: Synthetic peptide
  Seed: LVLMAVVLASLIYRRRLMKQDFS (PMEL_HUMAN)
  Core: YRRRLMKQD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIXRRXLXKQXFS

SEQ ID NO: 332356 - protein, 24 aa, Artificial Sequence
  Description of Artificial Sequence: Synthetic peptide
  Seed: LVLMAVVLASLIYRRRLMKQDFSV (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMKQDFSV

SEQ ID NO: 332357 - protein, 24 aa, Artificial Sequence
  Description of Artificial Sequence: Synthetic peptide
  Seed: LVLMAVVLASLIYRRRLMKQDFSV (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMKQDFSV

SEQ ID NO: 332358 - protein, 24 aa, Artificial Sequence
  Description of Artificial Sequence: Synthetic peptide
  Seed: LVLMAVVLASLIYRRRLMKQDFSV (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMKQDFSV

SEQ ID NO: 332359 - protein, 24 aa, Artificial Sequence
  Description of Artificial Sequence: Synthetic peptide
  Seed: LVLMAVVLASLIYRRRLMKQDFSV (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMKQDFSV

SEQ ID NO: 332360 - protein, 24 aa, Artificial Sequence
  Description of Artificial Sequence: Synthetic peptide
  Seed: LVLMAVVLASLIYRRRLMKQDFSV (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXKQDFSV

SEQ ID NO: 332361 - protein, 24 aa, Artificial Sequence
  Description of Artificial Sequence: Synthetic peptide
  Seed: LVLMAVVLASLIYRRRLMKQDFSV (PMEL_HUMAN)
  Core: LIYRRRLMK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASXIYXRXLMXQDFSV

SEQ ID NO: 332362 - protein, 24 aa, Artificial Sequence
  Description of Artificial Sequence: Synthetic peptide
  Seed: LVLMAVVLASLIYRRRLMKQDFSV (PMEL_HUMAN)
  Core: IYRRRLMKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLXYRXRXMKXDFSV

SEQ ID NO: 332363 - protein, 24 aa, Artificial Sequence
  Description of Artificial Sequence: Synthetic peptide
  Seed: LVLMAVVLASLIYRRRLMKQDFSV (PMEL_HUMAN)
  Core: YRRRLMKQD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIXRRXLXKQXFSV

SEQ ID NO: 332364 - protein, 24 aa, Artificial Sequence
  Description of Artificial Sequence: Synthetic peptide
  Seed: LVLMAVVLASLIYRRRLMKQDFSV (PMEL_HUMAN)
  Core: RRLMKQDFS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIYRXRLXKXDFXV

SEQ ID NO: 332365 - protein, 25 aa, Artificial Sequence
  Description of Artificial Sequence: Synthetic peptide
  Seed: LVLMAVVLASLIYRRRLMKQDFSVP (PMEL_HUMAN)
  Core: MAVVLASLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVLXAVXLXSLXYRRRLMKQDFSVP

SEQ ID NO: 332366 - protein, 25 aa, Artificial Sequence
  Description of Artificial Sequence: Synthetic peptide
  Seed: LVLMAVVLASLIYRRRLMKQDFSVP (PMEL_HUMAN)
  Core: VLASLIYRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVXLAXLXYRXRLMKQDFSVP

SEQ ID NO: 332367 - protein, 25 aa, Artificial Sequence
  Description of Artificial Sequence: Synthetic peptide
  Seed: LVLMAVVLASLIYRRRLMKQDFSVP (PMEL_HUMAN)
  Core: LASLIYRRR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVXASXIXRRXLMKQDFSVP

SEQ ID NO: 332368 - protein, 25 aa, Artificial Sequence
  Description of Artificial Sequence: Synthetic peptide
  Seed: LVLMAVVLASLIYRRRLMKQDFSVP (PMEL_HUMAN)
  Core: ASLIYRRRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLXSLXYXRRXMKQDFSVP

SEQ ID NO: 332369 - protein, 25 aa, Artificial Sequence
  Description of Artificial Sequence: Synthetic peptide
  Seed: LVLMAVVLASLIYRRRLMKQDFSVP (PMEL_HUMAN)
  Core: SLIYRRRLM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLAXLIXRXRLXKQDFSVP

SEQ ID NO: 332370 - protein, 25 aa, Artificial Sequence
  Description of Artificial Sequence: Synthetic peptide
  Seed: LVLMAVVLASLIYRRRLMKQDFSVP (PMEL_HUMAN)
  Core: LIYRRRLMK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASXIYXRXLMXQDFSVP

SEQ ID NO: 332371 - protein, 25 aa, Artificial Sequence
  Description of Artificial Sequence: Synthetic peptide
  Seed: LVLMAVVLASLIYRRRLMKQDFSVP (PMEL_HUMAN)
  Core: IYRRRLMKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLXYRXRXMKXDFSVP

SEQ ID NO: 332372 - protein, 25 aa, Artificial Sequence
  Description of Artificial Sequence: Synthetic peptide
  Seed: LVLMAVVLASLIYRRRLMKQDFSVP (PMEL_HUMAN)
  Core: YRRRLMKQD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIXRRXLXKQXFSVP

SEQ ID NO: 332373 - protein, 25 aa, Artificial Sequence
  Description of Artificial Sequence: Synthetic peptide
  Seed: LVLMAVVLASLIYRRRLMKQDFSVP (PMEL_HUMAN)
  Core: RRLMKQDFS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIYRXRLXKXDFXVP

SEQ ID NO: 332374 - protein, 25 aa, Artificial Sequence
  Description of Artificial Sequence: Synthetic peptide
  Seed: LVLMAVVLASLIYRRRLMKQDFSVP (PMEL_HUMAN)
  Core: RLMKQDFSV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LVLMAVVLASLIYRRXLMXQXFSXP

SEQ ID NO: 332375 - protein, 14 aa, Artificial Sequence
  Description of Artificial Sequence: Synthetic peptide
  Seed: LVVTHTYLEPGPVT (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVT

SEQ ID NO: 332376 - protein, 14 aa, Artificial Sequence
  Description of Artificial Sequence: Synthetic peptide
  Seed: LVVTHTYLEPGPVT (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVT

SEQ ID NO: 332377 - protein, 15 aa, Artificial Sequence
  Description of Artificial Sequence: Synthetic peptide
  Seed: LVVTHTYLEPGPVTA (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTA

SEQ ID NO: 332378 - protein, 15 aa, Artificial Sequence
  Description of Artificial Sequence: Synthetic peptide
  Seed: LVVTHTYLEPGPVTA (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTA

SEQ ID NO: 332379 - protein, 15 aa, Artificial Sequence
  Description of Artificial Sequence: Synthetic peptide
  Seed: LVVTHTYLEPGPVTA (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTA

SEQ ID NO: 332380 - protein, 16 aa, Artificial Sequence
  Description of Artificial Sequence: Synthetic peptide
  Seed: LVVTHTYLEPGPVTAQ (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQ

SEQ ID NO: 332381 - protein, 16 aa, Artificial Sequence
  Description of Artificial Sequence: Synthetic peptide
  Seed: LVVTHTYLEPGPVTAQ (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTAQ

SEQ ID NO: 332382 - protein, 16 aa, Artificial Sequence
  Description of Artificial Sequence: Synthetic peptide
  Seed: LVVTHTYLEPGPVTAQ (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTAQ

SEQ ID NO: 332383 - protein, 17 aa, Artificial Sequence
  Description of Artificial Sequence: Synthetic peptide
  Seed: LVVTHTYLEPGPVTAQV (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQV

SEQ ID NO: 332384 - protein, 17 aa, Artificial Sequence
  Description of Artificial Sequence: Synthetic peptide
  Seed: LVVTHTYLEPGPVTAQV (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTAQV

SEQ ID NO: 332385 - protein, 17 aa, Artificial Sequence
  Description of Artificial Sequence: Synthetic peptide
  Seed: LVVTHTYLEPGPVTAQV (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTAQV

SEQ ID NO: 332386 - protein, 18 aa, Artificial Sequence
  Description of Artificial Sequence: Synthetic peptide
  Seed: LVVTHTYLEPGPVTAQVV (PMEL_HUMAN)
  Core: LEPGPVTAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYXEPXPXTAXVV

SEQ ID NO: 332387 - protein, 19 aa, Artificial Sequence
  Description of Artificial Sequence: Synthetic peptide
  Seed: LVVTHTYLEPGPVTAQVVL (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQVVL

SEQ ID NO: 332388 - protein, 19 aa, Artificial Sequence
  Description of Artificial Sequence: Synthetic peptide
  Seed: LVVTHTYLEPGPVTAQVVL (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTAQVVL

SEQ ID NO: 332389 - protein, 19 aa, Artificial Sequence
  Description of Artificial Sequence: Synthetic peptide
  Seed: LVVTHTYLEPGPVTAQVVL (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTAQVVL

SEQ ID NO: 332390 - protein, 19 aa, Artificial Sequence
  Description of Artificial Sequence: Synthetic peptide
  Seed: LVVTHTYLEPGPVTAQVVL (PMEL_HUMAN)
  Core: LEPGPVTAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYXEPXPXTAXVVL

SEQ ID NO: 332391 - protein, 19 aa, Artificial Sequence
  Description of Artificial Sequence: Synthetic peptide
  Seed: LVVTHTYLEPGPVTAQVVL (PMEL_HUMAN)
  Core: PGPVTAQVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEXGPXTXQVXL

SEQ ID NO: 332392 - protein, 20 aa, Artificial Sequence
  Description of Artificial Sequence: Synthetic peptide
  Seed: LVVTHTYLEPGPVTAQVVLQ (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQVVLQ

SEQ ID NO: 332393 - protein, 20 aa, Artificial Sequence
  Description of Artificial Sequence: Synthetic peptide
  Seed: LVVTHTYLEPGPVTAQVVLQ (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTAQVVLQ

SEQ ID NO: 332394 - protein, 20 aa, Artificial Sequence
  Description of Artificial Sequence: Synthetic peptide
  Seed: LVVTHTYLEPGPVTAQVVLQ (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTAQVVLQ

SEQ ID NO: 332395 - protein, 20 aa, Artificial Sequence
  Description of Artificial Sequence: Synthetic peptide
  Seed: LVVTHTYLEPGPVTAQVVLQ (PMEL_HUMAN)
  Core: YLEPGPVTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTXLEXGXVTXQVVLQ

SEQ ID NO: 332396 - protein, 20 aa, Artificial Sequence
  Description of Artificial Sequence: Synthetic peptide
  Seed: LVVTHTYLEPGPVTAQVVLQ (PMEL_HUMAN)
  Core: PGPVTAQVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEXGPXTXQVXLQ

SEQ ID NO: 332397 - protein, 20 aa, Artificial Sequence
  Description of Artificial Sequence: Synthetic peptide
  Seed: LVVTHTYLEPGPVTAQVVLQ (PMEL_HUMAN)
  Core: PVTAQVVLQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGXVTXQXVLX

SEQ ID NO: 332398 - protein, 21 aa, Artificial Sequence
  Description of Artificial Sequence: Synthetic peptide
  Seed: LVVTHTYLEPGPVTAQVVLQA (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQVVLQA

SEQ ID NO: 332399 - protein, 21 aa, Artificial Sequence
  Description of Artificial Sequence: Synthetic peptide
  Seed: LVVTHTYLEPGPVTAQVVLQA (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTAQVVLQA

SEQ ID NO: 332400 - protein, 21 aa, Artificial Sequence
  Description of Artificial Sequence: Synthetic peptide
  Seed: LVVTHTYLEPGPVTAQVVLQA (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTAQVVLQA

SEQ ID NO: 332401 - protein, 21 aa, Artificial Sequence
  Description of Artificial Sequence: Synthetic peptide
  Seed: LVVTHTYLEPGPVTAQVVLQA (PMEL_HUMAN)
  Core: YLEPGPVTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTXLEXGXVTXQVVLQA

SEQ ID NO: 332402 - protein, 21 aa, Artificial Sequence
  Description of Artificial Sequence: Synthetic peptide
  Seed: LVVTHTYLEPGPVTAQVVLQA (PMEL_HUMAN)
  Core: PGPVTAQVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEXGPXTXQVXLQA

SEQ ID NO: 332403 - protein, 21 aa, Artificial Sequence
  Description of Artificial Sequence: Synthetic peptide
  Seed: LVVTHTYLEPGPVTAQVVLQA (PMEL_HUMAN)
  Core: PVTAQVVLQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGXVTXQXVLXA

SEQ ID NO: 332404 - protein, 21 aa, Artificial Sequence
  Description of Artificial Sequence: Synthetic peptide
  Seed: LVVTHTYLEPGPVTAQVVLQA (PMEL_HUMAN)
  Core: VTAQVVLQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPXTAXVXLQX

SEQ ID NO: 332405 - protein, 22 aa, Artificial Sequence
  Description of Artificial Sequence: Synthetic peptide
  Seed: LVVTHTYLEPGPVTAQVVLQAA (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQVVLQAA

SEQ ID NO: 332406 - protein, 22 aa, Artificial Sequence
  Description of Artificial Sequence: Synthetic peptide
  Seed: LVVTHTYLEPGPVTAQVVLQAA (PMEL_HUMAN)
  Core: VTHTYLEPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXTHXYXEPXPVTAQVVLQAA

SEQ ID NO: 332407 - protein, 22 aa, Artificial Sequence
  Description of Artificial Sequence: Synthetic peptide
  Seed: LVVTHTYLEPGPVTAQVVLQAA (PMEL_HUMAN)
  Core: HTYLEPGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LVVTXTYXEXGPXTAQVVLQAA

SEQ ID NO: 332408 - protein, 22 aa, Artificial Sequence
  Description of Artificial Sequence: Synthetic peptide
  Seed: LVVTHTYLEPGPVTAQVVLQAA (PMEL_HUMAN)
  Core: YLEPGPVTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTXLEXGXVTXQVVLQAA

SEQ ID NO: 332409 - protein, 22 aa, Artificial Sequence
  Description of Artificial Sequence: Synthetic peptide
  Seed: LVVTHTYLEPGPVTAQVVLQAA (PMEL_HUMAN)
  Core: PGPVTAQVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEXGPXTXQVXLQAA

SEQ ID NO: 332410 - protein, 22 aa, Artificial Sequence
  Description of Artificial Sequence: Synthetic peptide
  Seed: LVVTHTYLEPGPVTAQVVLQAA (PMEL_HUMAN)
  Core: PVTAQVVLQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGXVTXQXVLXAA

SEQ ID NO: 332411 - protein, 22 aa, Artificial Sequence
  Description of Artificial Sequence: Synthetic peptide
  Seed: LVVTHTYLEPGPVTAQVVLQAA (PMEL_HUMAN)
  Core: VTAQVVLQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPXTAXVXLQXA

SEQ ID NO: 332412 - protein, 23 aa, Artificial Sequence
  Description of Artificial Sequence: Synthetic peptide
  Seed: LVVTHTYLEPGPVTAQVVLQAAI (PMEL_HUMAN)
  Core: VVTHTYLEP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXVTXTXLEXGPVTAQVVLQAAI

SEQ ID NO: 332413 - protein, 23 aa, Artificial Sequence
  Description of Artificial Sequence: Synthetic peptide
  Seed: LVVTHTYLEPGPVTAQVVLQAAI (PMEL_HUMAN)
  Core: YLEPGPVTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTXLEXGXVTXQVVLQAAI

SEQ ID NO: 332414 - protein, 23 aa, Artificial Sequence
  Description of Artificial Sequence: Synthetic peptide
  Seed: LVVTHTYLEPGPVTAQVVLQAAI (PMEL_HUMAN)
  Core: PVTAQVVLQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGXVTXQXVLXAAI

SEQ ID NO: 332415 - protein, 23 aa, Artificial Sequence
  Description of Artificial Sequence: Synthetic peptide
  Seed: LVVTHTYLEPGPVTAQVVLQAAI (PMEL_HUMAN)
  Core: VTAQVVLQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPXTAXVXLQXAI

SEQ ID NO: 332416 - protein, 23 aa, Artificial Sequence
  Description of Artificial Sequence: Synthetic peptide
  Seed: LVVTHTYLEPGPVTAQVVLQAAI (PMEL_HUMAN)
  Core: TAQVVLQAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPVXAQXVXQAXI

SEQ ID NO: 332417 - protein, 24 aa, Artificial Sequence
  Description of Artificial Sequence: Synthetic peptide
  Seed: LVVTHTYLEPGPVTAQVVLQAAIP (PMEL_HUMAN)
  Core: PVTAQVVLQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGXVTXQXVLXAAIP

SEQ ID NO: 332418 - protein, 24 aa, Artificial Sequence
  Description of Artificial Sequence: Synthetic peptide
  Seed: LVVTHTYLEPGPVTAQVVLQAAIP (PMEL_HUMAN)
  Core: VTAQVVLQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPXTAXVXLQXAIP

SEQ ID NO: 332419 - protein, 24 aa, Artificial Sequence
  Description of Artificial Sequence: Synthetic peptide
  Seed: LVVTHTYLEPGPVTAQVVLQAAIP (PMEL_HUMAN)
  Core: TAQVVLQAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPVXAQXVXQAXIP

SEQ ID NO: 332420 - protein, 25 aa, Artificial Sequence
  Description of Artificial Sequence: Synthetic peptide
  Seed: LVVTHTYLEPGPVTAQVVLQAAIPL (PMEL_HUMAN)
  Core: PGPVTAQVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEXGPXTXQVXLQAAIPL

SEQ ID NO: 332421 - protein, 25 aa, Artificial Sequence
  Description of Artificial Sequence: Synthetic peptide
  Seed: LVVTHTYLEPGPVTAQVVLQAAIPL (PMEL_HUMAN)
  Core: PVTAQVVLQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGXVTXQXVLXAAIPL

SEQ ID NO: 332422 - protein, 25 aa, Artificial Sequence
  Description of Artificial Sequence: Synthetic peptide
  Seed: LVVTHTYLEPGPVTAQVVLQAAIPL (PMEL_HUMAN)
  Core: VTAQVVLQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPXTAXVXLQXAIPL

SEQ ID NO: 332423 - protein, 25 aa, Artificial Sequence
  Description of Artificial Sequence: Synthetic peptide
  Seed: LVVTHTYLEPGPVTAQVVLQAAIPL (PMEL_HUMAN)
  Core: TAQVVLQAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LVVTHTYLEPGPVXAQXVXQAXIPL

SEQ ID NO: 332424 - protein, 24 aa, Artificial Sequence
  Description of Artificial Sequence: Synthetic peptide
  Seed: LYPEWTEAQRLDCWRGGQVSLKVS (PMEL_HUMAN)
  Core: WRGGQVSLK
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LYPEWTEAQRLDCXRGXQXSLXVS

SEQ ID NO: 332425 - protein, 25 aa, Artificial Sequence
  Description of Artificial Sequence: Synthetic peptide
  Seed: LYPEWTEAQRLDCWRGGQVSLKVSN (PMEL_HUMAN)
  Core: WRGGQVSLK
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LYPEWTEAQRLDCXRGXQXSLXVSN

SEQ ID NO: 332426 - protein, 13 aa, Artificial Sequence
  Description of Artificial Sequence: Synthetic peptide
  Seed: LYRYGSFSVTLDI (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDI

SEQ ID NO: 332427 - protein, 13 aa, Artificial Sequence
  Description of Artificial Sequence: Synthetic peptide
  Seed: LYRYGSFSVTLDI (PMEL_HUMAN)
  Core: YGSFSVTLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LYRXGSXSXTLXI

SEQ ID NO: 332428 - protein, 14 aa, Artificial Sequence
  Description of Artificial Sequence: Synthetic peptide
  Seed: LYRYGSFSVTLDIV (PMEL_HUMAN)
  Core: LYRYGSFSV
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XYRXGXFSXTLDIV

SEQ ID NO: 332429 - protein, 14 aa, Artificial Sequence
  Description of Artificial Sequence: Synthetic peptide
  Seed: LYRYGSFSVTLDIV (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIV

SEQ ID NO: 332430 - protein, 14 aa, Artificial Sequence
  Description of Artificial Sequence: Synthetic peptide
  Seed: LYRYGSFSVTLDIV (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIV

SEQ ID NO: 332431 - protein, 14 aa, Artificial Sequence
  Description of Artificial Sequence: Synthetic peptide
  Seed: LYRYGSFSVTLDIV (PMEL_HUMAN)
  Core: YGSFSVTLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LYRXGSXSXTLXIV

SEQ ID NO: 332432 - protein, 14 aa, Artificial Sequence
  Description of Artificial Sequence: Synthetic peptide
  Seed: LYRYGSFSVTLDIV (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIX

SEQ ID NO: 332433 - protein, 15 aa, Artificial Sequence
  Description of Artificial Sequence: Synthetic peptide
  Seed: LYRYGSFSVTLDIVQ (PMEL_HUMAN)
  Core: LYRYGSFSV
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XYRXGXFSXTLDIVQ

SEQ ID NO: 332434 - protein, 15 aa, Artificial Sequence
  Description of Artificial Sequence: Synthetic peptide
  Seed: LYRYGSFSVTLDIVQ (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQ

SEQ ID NO: 332435 - protein, 15 aa, Artificial Sequence
  Description of Artificial Sequence: Synthetic peptide
  Seed: LYRYGSFSVTLDIVQ (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQ

SEQ ID NO: 332436 - protein, 15 aa, Artificial Sequence
  Description of Artificial Sequence: Synthetic peptide
  Seed: LYRYGSFSVTLDIVQ (PMEL_HUMAN)
  Core: YGSFSVTLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LYRXGSXSXTLXIVQ

SEQ ID NO: 332437 - protein, 15 aa, Artificial Sequence
  Description of Artificial Sequence: Synthetic peptide
  Seed: LYRYGSFSVTLDIVQ (PMEL_HUMAN)
  Core: GSFSVTLDI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LYRYXSFXVXLDXVQ

SEQ ID NO: 332438 - protein, 15 aa, Artificial Sequence
  Description of Artificial Sequence: Synthetic peptide
  Seed: LYRYGSFSVTLDIVQ (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQ

SEQ ID NO: 332439 - protein, 15 aa, Artificial Sequence
  Description of Artificial Sequence: Synthetic peptide
  Seed: LYRYGSFSVTLDIVQ (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVX

SEQ ID NO: 332440 - protein, 16 aa, Artificial Sequence
  Description of Artificial Sequence: Synthetic peptide
  Seed: LYRYGSFSVTLDIVQG (PMEL_HUMAN)
  Core: LYRYGSFSV
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XYRXGXFSXTLDIVQG

SEQ ID NO: 332441 - protein, 16 aa, Artificial Sequence
  Description of Artificial Sequence: Synthetic peptide
  Seed: LYRYGSFSVTLDIVQG (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQG

SEQ ID NO: 332442 - protein, 16 aa, Artificial Sequence
  Description of Artificial Sequence: Synthetic peptide
  Seed: LYRYGSFSVTLDIVQG (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQG

SEQ ID NO: 332443 - protein, 16 aa, Artificial Sequence
  Description of Artificial Sequence: Synthetic peptide
  Seed: LYRYGSFSVTLDIVQG (PMEL_HUMAN)
  Core: YGSFSVTLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LYRXGSXSXTLXIVQG

SEQ ID NO: 332444 - protein, 16 aa, Artificial Sequence
  Description of Artificial Sequence: Synthetic peptide
  Seed: LYRYGSFSVTLDIVQG (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQG

SEQ ID NO: 332445 - protein, 16 aa, Artificial Sequence
  Description of Artificial Sequence: Synthetic peptide
  Seed: LYRYGSFSVTLDIVQG (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXG

SEQ ID NO: 332446 - protein, 17 aa, Artificial Sequence
  Description of Artificial Sequence: Synthetic peptide
  Seed: LYRYGSFSVTLDIVQGI (PMEL_HUMAN)
  Core: LYRYGSFSV
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XYRXGXFSXTLDIVQGI

SEQ ID NO: 332447 - protein, 17 aa, Artificial Sequence
  Description of Artificial Sequence: Synthetic peptide
  Seed: LYRYGSFSVTLDIVQGI (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGI

SEQ ID NO: 332448 - protein, 17 aa, Artificial Sequence
  Description of Artificial Sequence: Synthetic peptide
  Seed: LYRYGSFSVTLDIVQGI (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGI

SEQ ID NO: 332449 - protein, 17 aa, Artificial Sequence
  Description of Artificial Sequence: Synthetic peptide
  Seed: LYRYGSFSVTLDIVQGI (PMEL_HUMAN)
  Core: YGSFSVTLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LYRXGSXSXTLXIVQGI

SEQ ID NO: 332450 - protein, 17 aa, Artificial Sequence
  Description of Artificial Sequence: Synthetic peptide
  Seed: LYRYGSFSVTLDIVQGI (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQGI

SEQ ID NO: 332451 - protein, 17 aa, Artificial Sequence
  Description of Artificial Sequence: Synthetic peptide
  Seed: LYRYGSFSVTLDIVQGI (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGI

SEQ ID NO: 332452 - protein, 18 aa, Artificial Sequence
  Description of Artificial Sequence: Synthetic peptide
  Seed: LYRYGSFSVTLDIVQGIE (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIE

SEQ ID NO: 332453 - protein, 18 aa, Artificial Sequence
  Description of Artificial Sequence: Synthetic peptide
  Seed: LYRYGSFSVTLDIVQGIE (PMEL_HUMAN)
  Core: YGSFSVTLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LYRXGSXSXTLXIVQGIE

SEQ ID NO: 332454 - protein, 18 aa, Artificial Sequence
  Description of Artificial Sequence: Synthetic peptide
  Seed: LYRYGSFSVTLDIVQGIE (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQGIE

SEQ ID NO: 332455 - protein, 18 aa, Artificial Sequence
  Description of Artificial Sequence: Synthetic peptide
  Seed: LYRYGSFSVTLDIVQGIE (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIE

SEQ ID NO: 332456 - protein, 18 aa, Artificial Sequence
  Description of Artificial Sequence: Synthetic peptide
  Seed: LYRYGSFSVTLDIVQGIE (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXE

SEQ ID NO: 332457 - protein, 19 aa, Artificial Sequence
  Description of Artificial Sequence: Synthetic peptide
  Seed: LYRYGSFSVTLDIVQGIES (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIES

SEQ ID NO: 332458 - protein, 19 aa, Artificial Sequence
  Description of Artificial Sequence: Synthetic peptide
  Seed: LYRYGSFSVTLDIVQGIES (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIES

SEQ ID NO: 332459 - protein, 19 aa, Artificial Sequence
  Description of Artificial Sequence: Synthetic peptide
  Seed: LYRYGSFSVTLDIVQGIES (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQGIES

SEQ ID NO: 332460 - protein, 19 aa, Artificial Sequence
  Description of Artificial Sequence: Synthetic peptide
  Seed: LYRYGSFSVTLDIVQGIES (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIES

SEQ ID NO: 332461 - protein, 19 aa, Artificial Sequence
  Description of Artificial Sequence: Synthetic peptide
  Seed: LYRYGSFSVTLDIVQGIES (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXES

SEQ ID NO: 332462 - protein, 20 aa, Artificial Sequence
  Description of Artificial Sequence: Synthetic peptide
  Seed: LYRYGSFSVTLDIVQGIESA (PMEL_HUMAN)
  Core: LYRYGSFSV
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XYRXGXFSXTLDIVQGIESA

SEQ ID NO: 332463 - protein, 20 aa, Artificial Sequence
  Description of Artificial Sequence: Synthetic peptide
  Seed: LYRYGSFSVTLDIVQGIESA (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIESA

SEQ ID NO: 332464 - protein, 20 aa, Artificial Sequence
  Description of Artificial Sequence: Synthetic peptide
  Seed: LYRYGSFSVTLDIVQGIESA (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIESA

SEQ ID NO: 332465 - protein, 20 aa, Artificial Sequence
  Description of Artificial Sequence: Synthetic peptide
  Seed: LYRYGSFSVTLDIVQGIESA (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQGIESA

SEQ ID NO: 332466 - protein, 20 aa, Artificial Sequence
  Description of Artificial Sequence: Synthetic peptide
  Seed: LYRYGSFSVTLDIVQGIESA (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIESA

SEQ ID NO: 332467 - protein, 20 aa, Artificial Sequence
  Description of Artificial Sequence: Synthetic peptide
  Seed: LYRYGSFSVTLDIVQGIESA (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXESA

SEQ ID NO: 332468 - protein, 20 aa, Artificial Sequence
  Description of Artificial Sequence: Synthetic peptide
  Seed: LYRYGSFSVTLDIVQGIESA (PMEL_HUMAN)
  Core: LDIVQGIES
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTXDIXQXIEXA

SEQ ID NO: 332469 - protein, 21 aa, Artificial Sequence
  Description of Artificial Sequence: Synthetic peptide
  Seed: LYRYGSFSVTLDIVQGIESAE (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIESAE

SEQ ID NO: 332470 - protein, 21 aa, Artificial Sequence
  Description of Artificial Sequence: Synthetic peptide
  Seed: LYRYGSFSVTLDIVQGIESAE (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIESAE

SEQ ID NO: 332471 - protein, 21 aa, Artificial Sequence
  Description of Artificial Sequence: Synthetic peptide
  Seed: LYRYGSFSVTLDIVQGIESAE (PMEL_HUMAN)
  Core: GSFSVTLDI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LYRYXSFXVXLDXVQGIESAE

SEQ ID NO: 332472 - protein, 21 aa, Artificial Sequence
  Description of Artificial Sequence: Synthetic peptide
  Seed: LYRYGSFSVTLDIVQGIESAE (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQGIESAE

SEQ ID NO: 332473 - protein, 21 aa, Artificial Sequence
  Description of Artificial Sequence: Synthetic peptide
  Seed: LYRYGSFSVTLDIVQGIESAE (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIESAE

SEQ ID NO: 332474 - protein, 21 aa, Artificial Sequence
  Description of Artificial Sequence: Synthetic peptide
  Seed: LYRYGSFSVTLDIVQGIESAE (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXESAE

SEQ ID NO: 332475 - protein, 21 aa, Artificial Sequence
  Description of Artificial Sequence: Synthetic peptide
  Seed: LYRYGSFSVTLDIVQGIESAE (PMEL_HUMAN)
  Core: LDIVQGIES
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTXDIXQXIEXAE

SEQ ID NO: 332476 - protein, 22 aa, Artificial Sequence
  Description of Artificial Sequence: Synthetic peptide
  Seed: LYRYGSFSVTLDIVQGIESAEI (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIESAEI

SEQ ID NO: 332477 - protein, 22 aa, Artificial Sequence
  Description of Artificial Sequence: Synthetic peptide
  Seed: LYRYGSFSVTLDIVQGIESAEI (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIESAEI

SEQ ID NO: 332478 - protein, 22 aa, Artificial Sequence
  Description of Artificial Sequence: Synthetic peptide
  Seed: LYRYGSFSVTLDIVQGIESAEI (PMEL_HUMAN)
  Core: SFSVTLDIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGXFSXTXDIXQGIESAEI

SEQ ID NO: 332479 - protein, 22 aa, Artificial Sequence
  Description of Artificial Sequence: Synthetic peptide
  Seed: LYRYGSFSVTLDIVQGIESAEI (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIESAEI

SEQ ID NO: 332480 - protein, 22 aa, Artificial Sequence
  Description of Artificial Sequence: Synthetic peptide
  Seed: LYRYGSFSVTLDIVQGIESAEI (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXESAEI

SEQ ID NO: 332481 - protein, 22 aa, Artificial Sequence
  Description of Artificial Sequence: Synthetic peptide
  Seed: LYRYGSFSVTLDIVQGIESAEI (PMEL_HUMAN)
  Core: LDIVQGIES
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTXDIXQXIEXAEI

SEQ ID NO: 332482 - protein, 22 aa, Artificial Sequence
  Description of Artificial Sequence: Synthetic peptide
  Seed: LYRYGSFSVTLDIVQGIESAEI (PMEL_HUMAN)
  Core: VQGIESAEI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTLDIXQGXEXAEX

SEQ ID NO: 332483 - protein, 23 aa, Artificial Sequence
  Description of Artificial Sequence: Synthetic peptide
  Seed: LYRYGSFSVTLDIVQGIESAEIL (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIESAEIL

SEQ ID NO: 332484 - protein, 23 aa, Artificial Sequence
  Description of Artificial Sequence: Synthetic peptide
  Seed: LYRYGSFSVTLDIVQGIESAEIL (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIESAEIL

SEQ ID NO: 332485 - protein, 23 aa, Artificial Sequence
  Description of Artificial Sequence: Synthetic peptide
  Seed: LYRYGSFSVTLDIVQGIESAEIL (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIESAEIL

SEQ ID NO: 332486 - protein, 23 aa, Artificial Sequence
  Description of Artificial Sequence: Synthetic peptide
  Seed: LYRYGSFSVTLDIVQGIESAEIL (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXESAEIL

SEQ ID NO: 332487 - protein, 23 aa, Artificial Sequence
  Description of Artificial Sequence: Synthetic peptide
  Seed: LYRYGSFSVTLDIVQGIESAEIL (PMEL_HUMAN)
  Core: LDIVQGIES
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTXDIXQXIEXAEIL

SEQ ID NO: 332488 - protein, 23 aa, Artificial Sequence
  Description of Artificial Sequence: Synthetic peptide
  Seed: LYRYGSFSVTLDIVQGIESAEIL (PMEL_HUMAN)
  Core: VQGIESAEI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTLDIXQGXEXAEXL

SEQ ID NO: 332489 - protein, 24 aa, Artificial Sequence
  Description of Artificial Sequence: Synthetic peptide
  Seed: LYRYGSFSVTLDIVQGIESAEILQ (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIESAEILQ

SEQ ID NO: 332490 - protein, 24 aa, Artificial Sequence
  Description of Artificial Sequence: Synthetic peptide
  Seed: LYRYGSFSVTLDIVQGIESAEILQ (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIESAEILQ

SEQ ID NO: 332491 - protein, 24 aa, Artificial Sequence
  Description of Artificial Sequence: Synthetic peptide
  Seed: LYRYGSFSVTLDIVQGIESAEILQ (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIESAEILQ

SEQ ID NO: 332492 - protein, 24 aa, Artificial Sequence
  Description of Artificial Sequence: Synthetic peptide
  Seed: LYRYGSFSVTLDIVQGIESAEILQ (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXESAEILQ

SEQ ID NO: 332493 - protein, 24 aa, Artificial Sequence
  Description of Artificial Sequence: Synthetic peptide
  Seed: LYRYGSFSVTLDIVQGIESAEILQ (PMEL_HUMAN)
  Core: LDIVQGIES
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTXDIXQXIEXAEILQ

SEQ ID NO: 332494 - protein, 24 aa, Artificial Sequence
  Description of Artificial Sequence: Synthetic peptide
  Seed: LYRYGSFSVTLDIVQGIESAEILQ (PMEL_HUMAN)
  Core: VQGIESAEI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTLDIXQGXEXAEXLQ

SEQ ID NO: 332495 - protein, 25 aa, Artificial Sequence
  Description of Artificial Sequence: Synthetic peptide
  Seed: LYRYGSFSVTLDIVQGIESAEILQA (PMEL_HUMAN)
  Core: YRYGSFSVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXRYXSXSVXLDIVQGIESAEILQA

SEQ ID NO: 332496 - protein, 25 aa, Artificial Sequence
  Description of Artificial Sequence: Synthetic peptide
  Seed: LYRYGSFSVTLDIVQGIESAEILQA (PMEL_HUMAN)
  Core: RYGSFSVTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LYXYGXFXVTXDIVQGIESAEILQA

SEQ ID NO: 332497 - protein, 25 aa, Artificial Sequence
  Description of Artificial Sequence: Synthetic peptide
  Seed: LYRYGSFSVTLDIVQGIESAEILQA (PMEL_HUMAN)
  Core: FSVTLDIVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSXSVXLXIVXGIESAEILQA

SEQ ID NO: 332498 - protein, 25 aa, Artificial Sequence
  Description of Artificial Sequence: Synthetic peptide
  Seed: LYRYGSFSVTLDIVQGIESAEILQA (PMEL_HUMAN)
  Core: VTLDIVQGI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSXTLXIXQGXESAEILQA

SEQ ID NO: 332499 - protein, 25 aa, Artificial Sequence
  Description of Artificial Sequence: Synthetic peptide
  Seed: LYRYGSFSVTLDIVQGIESAEILQA (PMEL_HUMAN)
  Core: LDIVQGIES
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTXDIXQXIEXAEILQA

SEQ ID NO: 332500 - protein, 25 aa, Artificial Sequence
  Description of Artificial Sequence: Synthetic peptide
  Seed: LYRYGSFSVTLDIVQGIESAEILQA (PMEL_HUMAN)
  Core: VQGIESAEI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTLDIXQGXEXAEXLQA

SEQ ID NO: 332501 - protein, 25 aa, Artificial Sequence
  Description of Artificial Sequence: Synthetic peptide
  Seed: LYRYGSFSVTLDIVQGIESAEILQA (PMEL_HUMAN)
  Core: IESAEILQA
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
LYRYGSFSVTLDIVQGXESXEXLQX

SEQ ID NO: 332502 - protein, 13 aa, Artificial Sequence
  Description of Artificial Sequence: Synthetic peptide
  Seed: MAVVLASLIYRRR (PMEL_HUMAN)
  Core: VVLASLIYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MAXVLXSXIYXRR

SEQ ID NO: 332503 - protein, 13 aa, Artificial Sequence
  Description of Artificial Sequence: Synthetic peptide
  Seed: MAVVLASLIYRRR (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXR

SEQ ID NO: 332504 - protein, 13 aa, Artificial Sequence
  Description of Artificial Sequence: Synthetic peptide
  Seed: MAVVLASLIYRRR (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRX

SEQ ID NO: 332505 - protein, 14 aa, Artificial Sequence
  Description of Artificial Sequence: Synthetic peptide
  Seed: MAVVLASLIYRRRL (PMEL_HUMAN)
  Core: AVVLASLIY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
MXVVXAXLIXRRRL

SEQ ID NO: 332506 - protein, 14 aa, Artificial Sequence
  Description of Artificial Sequence: Synthetic peptide
  Seed: MAVVLASLIYRRRL (PMEL_HUMAN)
  Core: VVLASLIYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MAXVLXSXIYXRRL

SEQ ID NO: 332507 - protein, 14 aa, Artificial Sequence
  Description of Artificial Sequence: Synthetic peptide
  Seed: MAVVLASLIYRRRL (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRL

SEQ ID NO: 332508 - protein, 14 aa, Artificial Sequence
  Description of Artificial Sequence: Synthetic peptide
  Seed: MAVVLASLIYRRRL (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXL

SEQ ID NO: 332509 - protein, 15 aa, Artificial Sequence
  Description of Artificial Sequence: Synthetic peptide
  Seed: MAVVLASLIYRRRLM (PMEL_HUMAN)
  Core: AVVLASLIY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
MXVVXAXLIXRRRLM

SEQ ID NO: 332510 - protein, 15 aa, Artificial Sequence
  Description of Artificial Sequence: Synthetic peptide
  Seed: MAVVLASLIYRRRLM (PMEL_HUMAN)
  Core: VVLASLIYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MAXVLXSXIYXRRLM

SEQ ID NO: 332511 - protein, 15 aa, Artificial Sequence
  Description of Artificial Sequence: Synthetic peptide
  Seed: MAVVLASLIYRRRLM (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLM

SEQ ID NO: 332512 - protein, 15 aa, Artificial Sequence
  Description of Artificial Sequence: Synthetic peptide
  Seed: MAVVLASLIYRRRLM (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLM

SEQ ID NO: 332513 - protein, 16 aa, Artificial Sequence
  Description of Artificial Sequence: Synthetic peptide
  Seed: MAVVLASLIYRRRLMK (PMEL_HUMAN)
  Core: VVLASLIYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MAXVLXSXIYXRRLMK

SEQ ID NO: 332514 - protein, 16 aa, Artificial Sequence
  Description of Artificial Sequence: Synthetic peptide
  Seed: MAVVLASLIYRRRLMK (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMK

SEQ ID NO: 332515 - protein, 16 aa, Artificial Sequence
  Description of Artificial Sequence: Synthetic peptide
  Seed: MAVVLASLIYRRRLMK (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMK

SEQ ID NO: 332516 - protein, 16 aa, Artificial Sequence
  Description of Artificial Sequence: Synthetic peptide
  Seed: MAVVLASLIYRRRLMK (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMK

SEQ ID NO: 332517 - protein, 16 aa, Artificial Sequence
  Description of Artificial Sequence: Synthetic peptide
  Seed: MAVVLASLIYRRRLMK (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXK

SEQ ID NO: 332518 - protein, 17 aa, Artificial Sequence
  Description of Artificial Sequence: Synthetic peptide
  Seed: MAVVLASLIYRRRLMKQ (PMEL_HUMAN)
  Core: VVLASLIYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MAXVLXSXIYXRRLMKQ

SEQ ID NO: 332519 - protein, 17 aa, Artificial Sequence
  Description of Artificial Sequence: Synthetic peptide
  Seed: MAVVLASLIYRRRLMKQ (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQ

SEQ ID NO: 332520 - protein, 17 aa, Artificial Sequence
  Description of Artificial Sequence: Synthetic peptide
  Seed: MAVVLASLIYRRRLMKQ (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQ

SEQ ID NO: 332521 - protein, 17 aa, Artificial Sequence
  Description of Artificial Sequence: Synthetic peptide
  Seed: MAVVLASLIYRRRLMKQ (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQ

SEQ ID NO: 332522 - protein, 17 aa, Artificial Sequence
  Description of Artificial Sequence: Synthetic peptide
  Seed: MAVVLASLIYRRRLMKQ (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQ

SEQ ID NO: 332523 - protein, 17 aa, Artificial Sequence
  Description of Artificial Sequence: Synthetic peptide
  Seed: MAVVLASLIYRRRLMKQ (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQ

SEQ ID NO: 332524 - protein, 18 aa, Artificial Sequence
  Description of Artificial Sequence: Synthetic peptide
  Seed: MAVVLASLIYRRRLMKQD (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQD

SEQ ID NO: 332525 - protein, 18 aa, Artificial Sequence
  Description of Artificial Sequence: Synthetic peptide
  Seed: MAVVLASLIYRRRLMKQD (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQD

SEQ ID NO: 332526 - protein, 18 aa, Artificial Sequence
  Description of Artificial Sequence: Synthetic peptide
  Seed: MAVVLASLIYRRRLMKQD (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQD

SEQ ID NO: 332527 - protein, 18 aa, Artificial Sequence
  Description of Artificial Sequence: Synthetic peptide
  Seed: MAVVLASLIYRRRLMKQD (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQD

SEQ ID NO: 332528 - protein, 18 aa, Artificial Sequence
  Description of Artificial Sequence: Synthetic peptide
  Seed: MAVVLASLIYRRRLMKQD (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQD

SEQ ID NO: 332529 - protein, 18 aa, Artificial Sequence
  Description of Artificial Sequence: Synthetic peptide
  Seed: MAVVLASLIYRRRLMKQD (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXD

SEQ ID NO: 332530 - protein, 19 aa, Artificial Sequence
  Description of Artificial Sequence: Synthetic peptide
  Seed: MAVVLASLIYRRRLMKQDF (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDF

SEQ ID NO: 332531 - protein, 19 aa, Artificial Sequence
  Description of Artificial Sequence: Synthetic peptide
  Seed: MAVVLASLIYRRRLMKQDF (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDF

SEQ ID NO: 332532 - protein, 19 aa, Artificial Sequence
  Description of Artificial Sequence: Synthetic peptide
  Seed: MAVVLASLIYRRRLMKQDF (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDF

SEQ ID NO: 332533 - protein, 19 aa, Artificial Sequence
  Description of Artificial Sequence: Synthetic peptide
  Seed: MAVVLASLIYRRRLMKQDF (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDF

SEQ ID NO: 332534 - protein, 19 aa, Artificial Sequence
  Description of Artificial Sequence: Synthetic peptide
  Seed: MAVVLASLIYRRRLMKQDF (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDF

SEQ ID NO: 332535 - protein, 19 aa, Artificial Sequence
  Description of Artificial Sequence: Synthetic peptide
  Seed: MAVVLASLIYRRRLMKQDF (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDF

SEQ ID NO: 332536 - protein, 19 aa, Artificial Sequence
  Description of Artificial Sequence: Synthetic peptide
  Seed: MAVVLASLIYRRRLMKQDF (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXF

SEQ ID NO: 332537 - protein, 20 aa, Artificial Sequence
  Description of Artificial Sequence: Synthetic peptide
  Seed: MAVVLASLIYRRRLMKQDFS (PMEL_HUMAN)
  Core: VVLASLIYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MAXVLXSXIYXRRLMKQDFS

SEQ ID NO: 332538 - protein, 20 aa, Artificial Sequence
  Description of Artificial Sequence: Synthetic peptide
  Seed: MAVVLASLIYRRRLMKQDFS (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDFS

SEQ ID NO: 332539 - protein, 20 aa, Artificial Sequence
  Description of Artificial Sequence: Synthetic peptide
  Seed: MAVVLASLIYRRRLMKQDFS (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDFS

SEQ ID NO: 332540 - protein, 20 aa, Artificial Sequence
  Description of Artificial Sequence: Synthetic peptide
  Seed: MAVVLASLIYRRRLMKQDFS (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDFS

SEQ ID NO: 332541 - protein, 20 aa, Artificial Sequence
  Description of Artificial Sequence: Synthetic peptide
  Seed: MAVVLASLIYRRRLMKQDFS (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDFS

SEQ ID NO: 332542 - protein, 20 aa, Artificial Sequence
  Description of Artificial Sequence: Synthetic peptide
  Seed: MAVVLASLIYRRRLMKQDFS (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDFS

SEQ ID NO: 332543 - protein, 20 aa, Artificial Sequence
  Description of Artificial Sequence: Synthetic peptide
  Seed: MAVVLASLIYRRRLMKQDFS (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDFS

SEQ ID NO: 332544 - protein, 20 aa, Artificial Sequence
  Description of Artificial Sequence: Synthetic peptide
  Seed: MAVVLASLIYRRRLMKQDFS (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXFS

SEQ ID NO: 332545 - protein, 20 aa, Artificial Sequence
  Description of Artificial Sequence: Synthetic peptide
  Seed: MAVVLASLIYRRRLMKQDFS (PMEL_HUMAN)
  Core: RRLMKQDFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRXRLXKXDFX

SEQ ID NO: 332546 - protein, 21 aa, Artificial Sequence
  Description of Artificial Sequence: Synthetic peptide
  Seed: MAVVLASLIYRRRLMKQDFSV (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDFSV

SEQ ID NO: 332547 - protein, 21 aa, Artificial Sequence
  Description of Artificial Sequence: Synthetic peptide
  Seed: MAVVLASLIYRRRLMKQDFSV (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDFSV

SEQ ID NO: 332548 - protein, 21 aa, Artificial Sequence
  Description of Artificial Sequence: Synthetic peptide
  Seed: MAVVLASLIYRRRLMKQDFSV (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDFSV

SEQ ID NO: 332549 - protein, 21 aa, Artificial Sequence
  Description of Artificial Sequence: Synthetic peptide
  Seed: MAVVLASLIYRRRLMKQDFSV (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDFSV

SEQ ID NO: 332550 - protein, 21 aa, Artificial Sequence
  Description of Artificial Sequence: Synthetic peptide
  Seed: MAVVLASLIYRRRLMKQDFSV (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDFSV

SEQ ID NO: 332551 - protein, 21 aa, Artificial Sequence
  Description of Artificial Sequence: Synthetic peptide
  Seed: MAVVLASLIYRRRLMKQDFSV (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDFSV

SEQ ID NO: 332552 - protein, 21 aa, Artificial Sequence
  Description of Artificial Sequence: Synthetic peptide
  Seed: MAVVLASLIYRRRLMKQDFSV (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXFSV

SEQ ID NO: 332553 - protein, 21 aa, Artificial Sequence
  Description of Artificial Sequence: Synthetic peptide
  Seed: MAVVLASLIYRRRLMKQDFSV (PMEL_HUMAN)
  Core: RLMKQDFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRXLMXQXFSX

SEQ ID NO: 332554 - protein, 22 aa, Artificial Sequence
  Description of Artificial Sequence: Synthetic peptide
  Seed: MAVVLASLIYRRRLMKQDFSVP (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDFSVP

SEQ ID NO: 332555 - protein, 22 aa, Artificial Sequence
  Description of Artificial Sequence: Synthetic peptide
  Seed: MAVVLASLIYRRRLMKQDFSVP (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDFSVP

SEQ ID NO: 332556 - protein, 22 aa, Artificial Sequence
  Description of Artificial Sequence: Synthetic peptide
  Seed: MAVVLASLIYRRRLMKQDFSVP (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDFSVP

SEQ ID NO: 332557 - protein, 22 aa, Artificial Sequence
  Description of Artificial Sequence: Synthetic peptide
  Seed: MAVVLASLIYRRRLMKQDFSVP (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDFSVP

SEQ ID NO: 332558 - protein, 22 aa, Artificial Sequence
  Description of Artificial Sequence: Synthetic peptide
  Seed: MAVVLASLIYRRRLMKQDFSVP (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDFSVP

SEQ ID NO: 332559 - protein, 22 aa, Artificial Sequence
  Description of Artificial Sequence: Synthetic peptide
  Seed: MAVVLASLIYRRRLMKQDFSVP (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDFSVP

SEQ ID NO: 332560 - protein, 22 aa, Artificial Sequence
  Description of Artificial Sequence: Synthetic peptide
  Seed: MAVVLASLIYRRRLMKQDFSVP (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXFSVP

SEQ ID NO: 332561 - protein, 22 aa, Artificial Sequence
  Description of Artificial Sequence: Synthetic peptide
  Seed: MAVVLASLIYRRRLMKQDFSVP (PMEL_HUMAN)
  Core: RRLMKQDFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRXRLXKXDFXVP

SEQ ID NO: 332562 - protein, 22 aa, Artificial Sequence
  Description of Artificial Sequence: Synthetic peptide
  Seed: MAVVLASLIYRRRLMKQDFSVP (PMEL_HUMAN)
  Core: RLMKQDFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRXLMXQXFSXP

SEQ ID NO: 332563 - protein, 23 aa, Artificial Sequence
  Description of Artificial Sequence: Synthetic peptide
  Seed: MAVVLASLIYRRRLMKQDFSVPQ (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDFSVPQ

SEQ ID NO: 332564 - protein, 23 aa, Artificial Sequence
  Description of Artificial Sequence: Synthetic peptide
  Seed: MAVVLASLIYRRRLMKQDFSVPQ (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDFSVPQ

SEQ ID NO: 332565 - protein, 23 aa, Artificial Sequence
  Description of Artificial Sequence: Synthetic peptide
  Seed: MAVVLASLIYRRRLMKQDFSVPQ (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDFSVPQ

SEQ ID NO: 332566 - protein, 23 aa, Artificial Sequence
  Description of Artificial Sequence: Synthetic peptide
  Seed: MAVVLASLIYRRRLMKQDFSVPQ (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDFSVPQ

SEQ ID NO: 332567 - protein, 23 aa, Artificial Sequence
  Description of Artificial Sequence: Synthetic peptide
  Seed: MAVVLASLIYRRRLMKQDFSVPQ (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDFSVPQ

SEQ ID NO: 332568 - protein, 23 aa, Artificial Sequence
  Description of Artificial Sequence: Synthetic peptide
  Seed: MAVVLASLIYRRRLMKQDFSVPQ (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDFSVPQ

SEQ ID NO: 332569 - protein, 23 aa, Artificial Sequence
  Description of Artificial Sequence: Synthetic peptide
  Seed: MAVVLASLIYRRRLMKQDFSVPQ (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXFSVPQ

SEQ ID NO: 332570 - protein, 23 aa, Artificial Sequence
  Description of Artificial Sequence: Synthetic peptide
  Seed: MAVVLASLIYRRRLMKQDFSVPQ (PMEL_HUMAN)
  Core: RRLMKQDFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRXRLXKXDFXVPQ

SEQ ID NO: 332571 - protein, 23 aa, Artificial Sequence
  Description of Artificial Sequence: Synthetic peptide
  Seed: MAVVLASLIYRRRLMKQDFSVPQ (PMEL_HUMAN)
  Core: RLMKQDFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRXLMXQXFSXPQ

SEQ ID NO: 332572 - protein, 24 aa, Artificial Sequence
  Description of Artificial Sequence: Synthetic peptide
  Seed: MAVVLASLIYRRRLMKQDFSVPQL (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDFSVPQL

SEQ ID NO: 332573 - protein, 24 aa, Artificial Sequence
  Description of Artificial Sequence: Synthetic peptide
  Seed: MAVVLASLIYRRRLMKQDFSVPQL (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDFSVPQL

SEQ ID NO: 332574 - protein, 24 aa, Artificial Sequence
  Description of Artificial Sequence: Synthetic peptide
  Seed: MAVVLASLIYRRRLMKQDFSVPQL (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDFSVPQL

SEQ ID NO: 332575 - protein, 24 aa, Artificial Sequence
  Description of Artificial Sequence: Synthetic peptide
  Seed: MAVVLASLIYRRRLMKQDFSVPQL (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDFSVPQL

SEQ ID NO: 332576 - protein, 24 aa, Artificial Sequence
  Description of Artificial Sequence: Synthetic peptide
  Seed: MAVVLASLIYRRRLMKQDFSVPQL (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDFSVPQL

SEQ ID NO: 332577 - protein, 24 aa, Artificial Sequence
  Description of Artificial Sequence: Synthetic peptide
  Seed: MAVVLASLIYRRRLMKQDFSVPQL (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDFSVPQL

SEQ ID NO: 332578 - protein, 24 aa, Artificial Sequence
  Description of Artificial Sequence: Synthetic peptide
  Seed: MAVVLASLIYRRRLMKQDFSVPQL (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXFSVPQL

SEQ ID NO: 332579 - protein, 24 aa, Artificial Sequence
  Description of Artificial Sequence: Synthetic peptide
  Seed: MAVVLASLIYRRRLMKQDFSVPQL (PMEL_HUMAN)
  Core: RRLMKQDFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRXRLXKXDFXVPQL

SEQ ID NO: 332580 - protein, 24 aa, Artificial Sequence
  Description of Artificial Sequence: Synthetic peptide
  Seed: MAVVLASLIYRRRLMKQDFSVPQL (PMEL_HUMAN)
  Core: RLMKQDFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRXLMXQXFSXPQL

SEQ ID NO: 332581 - protein, 24 aa, Artificial Sequence
  Description of Artificial Sequence: Synthetic peptide
  Seed: MAVVLASLIYRRRLMKQDFSVPQL (PMEL_HUMAN)
  Core: LMKQDFSVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRRXMKXDXSVXQL

SEQ ID NO: 332582 - protein, 24 aa, Artificial Sequence
  Description of Artificial Sequence: Synthetic peptide
  Seed: MAVVLASLIYRRRLMKQDFSVPQL (PMEL_HUMAN)
  Core: MKQDFSVPQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRRLXKQXFXVPXL

SEQ ID NO: 332583 - protein, 25 aa, Artificial Sequence
  Description of Artificial Sequence: Synthetic peptide
  Seed: MAVVLASLIYRRRLMKQDFSVPQLP (PMEL_HUMAN)
  Core: VLASLIYRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MAVXLAXLXYRXRLMKQDFSVPQLP

SEQ ID NO: 332584 - protein, 25 aa, Artificial Sequence
  Description of Artificial Sequence: Synthetic peptide
  Seed: MAVVLASLIYRRRLMKQDFSVPQLP (PMEL_HUMAN)
  Core: LASLIYRRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MAVVXASXIXRRXLMKQDFSVPQLP

SEQ ID NO: 332585 - protein, 25 aa, Artificial Sequence
  Description of Artificial Sequence: Synthetic peptide
  Seed: MAVVLASLIYRRRLMKQDFSVPQLP (PMEL_HUMAN)
  Core: ASLIYRRRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLXSLXYXRRXMKQDFSVPQLP

SEQ ID NO: 332586 - protein, 25 aa, Artificial Sequence
  Description of Artificial Sequence: Synthetic peptide
  Seed: MAVVLASLIYRRRLMKQDFSVPQLP (PMEL_HUMAN)
  Core: SLIYRRRLM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLAXLIXRXRLXKQDFSVPQLP

SEQ ID NO: 332587 - protein, 25 aa, Artificial Sequence
  Description of Artificial Sequence: Synthetic peptide
  Seed: MAVVLASLIYRRRLMKQDFSVPQLP (PMEL_HUMAN)
  Core: LIYRRRLMK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASXIYXRXLMXQDFSVPQLP

SEQ ID NO: 332588 - protein, 25 aa, Artificial Sequence
  Description of Artificial Sequence: Synthetic peptide
  Seed: MAVVLASLIYRRRLMKQDFSVPQLP (PMEL_HUMAN)
  Core: IYRRRLMKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLXYRXRXMKXDFSVPQLP

SEQ ID NO: 332589 - protein, 25 aa, Artificial Sequence
  Description of Artificial Sequence: Synthetic peptide
  Seed: MAVVLASLIYRRRLMKQDFSVPQLP (PMEL_HUMAN)
  Core: YRRRLMKQD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIXRRXLXKQXFSVPQLP

SEQ ID NO: 332590 - protein, 25 aa, Artificial Sequence
  Description of Artificial Sequence: Synthetic peptide
  Seed: MAVVLASLIYRRRLMKQDFSVPQLP (PMEL_HUMAN)
  Core: RRLMKQDFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRXRLXKXDFXVPQLP

SEQ ID NO: 332591 - protein, 25 aa, Artificial Sequence
  Description of Artificial Sequence: Synthetic peptide
  Seed: MAVVLASLIYRRRLMKQDFSVPQLP (PMEL_HUMAN)
  Core: RLMKQDFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRXLMXQXFSXPQLP

SEQ ID NO: 332592 - protein, 25 aa, Artificial Sequence
  Description of Artificial Sequence: Synthetic peptide
  Seed: MAVVLASLIYRRRLMKQDFSVPQLP (PMEL_HUMAN)
  Core: LMKQDFSVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRRXMKXDXSVXQLP

SEQ ID NO: 332593 - protein, 25 aa, Artificial Sequence
  Description of Artificial Sequence: Synthetic peptide
  Seed: MAVVLASLIYRRRLMKQDFSVPQLP (PMEL_HUMAN)
  Core: MKQDFSVPQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
MAVVLASLIYRRRLXKQXFXVPXLP

SEQ ID NO: 332594 - protein, 13 aa, Artificial Sequence
  Description of Artificial Sequence: Synthetic peptide
  Seed: MDLVLKRCLLHLA (PMEL_HUMAN)
  Core: LVLKRCLLH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MDXVLXRXLLXLA

SEQ ID NO: 332595 - protein, 14 aa, Artificial Sequence
  Description of Artificial Sequence: Synthetic peptide
  Seed: MDLVLKRCLLHLAV (PMEL_HUMAN)
  Core: LVLKRCLLH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MDXVLXRXLLXLAV

SEQ ID NO: 332596 - protein, 14 aa, Artificial Sequence
  Description of Artificial Sequence: Synthetic peptide
  Seed: MDLVLKRCLLHLAV (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXV

SEQ ID NO: 332597 - protein, 15 aa, Artificial Sequence
  Description of Artificial Sequence: Synthetic peptide
  Seed: MDLVLKRCLLHLAVI (PMEL_HUMAN)
  Core: LVLKRCLLH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MDXVLXRXLLXLAVI

SEQ ID NO: 332598 - protein, 15 aa, Artificial Sequence
  Description of Artificial Sequence: Synthetic peptide
  Seed: MDLVLKRCLLHLAVI (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVI

SEQ ID NO: 332599 - protein, 16 aa, Artificial Sequence
  Description of Artificial Sequence: Synthetic peptide
  Seed: MDLVLKRCLLHLAVIG (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIG

SEQ ID NO: 332600 - protein, 17 aa, Artificial Sequence
  Description of Artificial Sequence: Synthetic peptide
  Seed: MDLVLKRCLLHLAVIGA (PMEL_HUMAN)
  Core: LVLKRCLLH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MDXVLXRXLLXLAVIGA

SEQ ID NO: 332601 - protein, 17 aa, Artificial Sequence
  Description of Artificial Sequence: Synthetic peptide
  Seed: MDLVLKRCLLHLAVIGA (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGA

SEQ ID NO: 332602 - protein, 17 aa, Artificial Sequence
  Description of Artificial Sequence: Synthetic peptide
  Seed: MDLVLKRCLLHLAVIGA (PMEL_HUMAN)
  Core: KRCLLHLAV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLXRCXLXLAXIGA

SEQ ID NO: 332603 - protein, 17 aa, Artificial Sequence
  Description of Artificial Sequence: Synthetic peptide
  Seed: MDLVLKRCLLHLAVIGA (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGA

SEQ ID NO: 332604 - protein, 17 aa, Artificial Sequence
  Description of Artificial Sequence: Synthetic peptide
  Seed: MDLVLKRCLLHLAVIGA (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGX

SEQ ID NO: 332605 - protein, 18 aa, Artificial Sequence
  Description of Artificial Sequence: Synthetic peptide
  Seed: MDLVLKRCLLHLAVIGAL (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGAL

SEQ ID NO: 332606 - protein, 18 aa, Artificial Sequence
  Description of Artificial Sequence: Synthetic peptide
  Seed: MDLVLKRCLLHLAVIGAL (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGAL

SEQ ID NO: 332607 - protein, 18 aa, Artificial Sequence
  Description of Artificial Sequence: Synthetic peptide
  Seed: MDLVLKRCLLHLAVIGAL (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGXL

SEQ ID NO: 332608 - protein, 19 aa, Artificial Sequence
  Description of Artificial Sequence: Synthetic peptide
  Seed: MDLVLKRCLLHLAVIGALL (PMEL_HUMAN)
  Core: LVLKRCLLH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MDXVLXRXLLXLAVIGALL

SEQ ID NO: 332609 - protein, 19 aa, Artificial Sequence
  Description of Artificial Sequence: Synthetic peptide
  Seed: MDLVLKRCLLHLAVIGALL (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALL

SEQ ID NO: 332610 - protein, 19 aa, Artificial Sequence
  Description of Artificial Sequence: Synthetic peptide
  Seed: MDLVLKRCLLHLAVIGALL (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALL

SEQ ID NO: 332611 - protein, 19 aa, Artificial Sequence
  Description of Artificial Sequence: Synthetic peptide
  Seed: MDLVLKRCLLHLAVIGALL (PMEL_HUMAN)
  Core: CLLHLAVIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRXLLXLXVIXALL

SEQ ID NO: 332612 - protein, 19 aa, Artificial Sequence
  Description of Artificial Sequence: Synthetic peptide
  Seed: MDLVLKRCLLHLAVIGALL (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGXLL

SEQ ID NO: 332613 - protein, 20 aa, Artificial Sequence
  Description of Artificial Sequence: Synthetic peptide
  Seed: MDLVLKRCLLHLAVIGALLA (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALLA

SEQ ID NO: 332614 - protein, 20 aa, Artificial Sequence
  Description of Artificial Sequence: Synthetic peptide
  Seed: MDLVLKRCLLHLAVIGALLA (PMEL_HUMAN)
  Core: KRCLLHLAV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLXRCXLXLAXIGALLA

SEQ ID NO: 332615 - protein, 20 aa, Artificial Sequence
  Description of Artificial Sequence: Synthetic peptide
  Seed: MDLVLKRCLLHLAVIGALLA (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALLA

SEQ ID NO: 332616 - protein, 20 aa, Artificial Sequence
  Description of Artificial Sequence: Synthetic peptide
  Seed: MDLVLKRCLLHLAVIGALLA (PMEL_HUMAN)
  Core: CLLHLAVIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRXLLXLXVIXALLA

SEQ ID NO: 332617 - protein, 20 aa, Artificial Sequence
  Description of Artificial Sequence: Synthetic peptide
  Seed: MDLVLKRCLLHLAVIGALLA (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGXLLA

SEQ ID NO: 332618 - protein, 20 aa, Artificial Sequence
  Description of Artificial Sequence: Synthetic peptide
  Seed: MDLVLKRCLLHLAVIGALLA (PMEL_HUMAN)
  Core: LAVIGALLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHXAVXGXLLX

SEQ ID NO: 332619 - protein, 21 aa, Artificial Sequence
  Description of Artificial Sequence: Synthetic peptide
  Seed: MDLVLKRCLLHLAVIGALLAV (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALLAV

SEQ ID NO: 332620 - protein, 21 aa, Artificial Sequence
  Description of Artificial Sequence: Synthetic peptide
  Seed: MDLVLKRCLLHLAVIGALLAV (PMEL_HUMAN)
  Core: KRCLLHLAV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLXRCXLXLAXIGALLAV

SEQ ID NO: 332621 - protein, 21 aa, Artificial Sequence
  Description of Artificial Sequence: Synthetic peptide
  Seed: MDLVLKRCLLHLAVIGALLAV (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALLAV

SEQ ID NO: 332622 - protein, 21 aa, Artificial Sequence
  Description of Artificial Sequence: Synthetic peptide
  Seed: MDLVLKRCLLHLAVIGALLAV (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGXLLAV

SEQ ID NO: 332623 - protein, 21 aa, Artificial Sequence
  Description of Artificial Sequence: Synthetic peptide
  Seed: MDLVLKRCLLHLAVIGALLAV (PMEL_HUMAN)
  Core: LAVIGALLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHXAVXGXLLXV

SEQ ID NO: 332624 - protein, 22 aa, Artificial Sequence
  Description of Artificial Sequence: Synthetic peptide
  Seed: MDLVLKRCLLHLAVIGALLAVG (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALLAVG

SEQ ID NO: 332625 - protein, 22 aa, Artificial Sequence
  Description of Artificial Sequence: Synthetic peptide
  Seed: MDLVLKRCLLHLAVIGALLAVG (PMEL_HUMAN)
  Core: KRCLLHLAV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLXRCXLXLAXIGALLAVG

SEQ ID NO: 332626 - protein, 22 aa, Artificial Sequence
  Description of Artificial Sequence: Synthetic peptide
  Seed: MDLVLKRCLLHLAVIGALLAVG (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALLAVG

SEQ ID NO: 332627 - protein, 22 aa, Artificial Sequence
  Description of Artificial Sequence: Synthetic peptide
  Seed: MDLVLKRCLLHLAVIGALLAVG (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGXLLAVG

SEQ ID NO: 332628 - protein, 22 aa, Artificial Sequence
  Description of Artificial Sequence: Synthetic peptide
  Seed: MDLVLKRCLLHLAVIGALLAVG (PMEL_HUMAN)
  Core: LAVIGALLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHXAVXGXLLXVG

SEQ ID NO: 332629 - protein, 23 aa, Artificial Sequence
  Description of Artificial Sequence: Synthetic peptide
  Seed: MDLVLKRCLLHLAVIGALLAVGA (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALLAVGA

SEQ ID NO: 332630 - protein, 23 aa, Artificial Sequence
  Description of Artificial Sequence: Synthetic peptide
  Seed: MDLVLKRCLLHLAVIGALLAVGA (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALLAVGA

SEQ ID NO: 332631 - protein, 23 aa, Artificial Sequence
  Description of Artificial Sequence: Synthetic peptide
  Seed: MDLVLKRCLLHLAVIGALLAVGA (PMEL_HUMAN)
  Core: LLHLAVIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCXLHXAXIGXLLAVGA

SEQ ID NO: 332632 - protein, 23 aa, Artificial Sequence
  Description of Artificial Sequence: Synthetic peptide
  Seed: MDLVLKRCLLHLAVIGALLAVGA (PMEL_HUMAN)
  Core: LAVIGALLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHXAVXGXLLXVGA

SEQ ID NO: 332633 - protein, 23 aa, Artificial Sequence
  Description of Artificial Sequence: Synthetic peptide
  Seed: MDLVLKRCLLHLAVIGALLAVGA (PMEL_HUMAN)
  Core: VIGALLAVG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHLAXIGXLXAVXA

SEQ ID NO: 332634 - protein, 24 aa, Artificial Sequence
  Description of Artificial Sequence: Synthetic peptide
  Seed: MDLVLKRCLLHLAVIGALLAVGAT (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALLAVGAT

SEQ ID NO: 332635 - protein, 24 aa, Artificial Sequence
  Description of Artificial Sequence: Synthetic peptide
  Seed: MDLVLKRCLLHLAVIGALLAVGAT (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALLAVGAT

SEQ ID NO: 332636 - protein, 24 aa, Artificial Sequence
  Description of Artificial Sequence: Synthetic peptide
  Seed: MDLVLKRCLLHLAVIGALLAVGAT (PMEL_HUMAN)
  Core: LAVIGALLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHXAVXGXLLXVGAT

SEQ ID NO: 332637 - protein, 24 aa, Artificial Sequence
  Description of Artificial Sequence: Synthetic peptide
  Seed: MDLVLKRCLLHLAVIGALLAVGAT (PMEL_HUMAN)
  Core: AVIGALLAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHLXVIXAXLAXGAT

SEQ ID NO: 332638 - protein, 24 aa, Artificial Sequence
  Description of Artificial Sequence: Synthetic peptide
  Seed: MDLVLKRCLLHLAVIGALLAVGAT (PMEL_HUMAN)
  Core: VIGALLAVG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHLAXIGXLXAVXAT

SEQ ID NO: 332639 - protein, 24 aa, Artificial Sequence
  Description of Artificial Sequence: Synthetic peptide
  Seed: MDLVLKRCLLHLAVIGALLAVGAT (PMEL_HUMAN)
  Core: IGALLAVGA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHLAVXGAXLXVGXT

SEQ ID NO: 332640 - protein, 25 aa, Artificial Sequence
  Description of Artificial Sequence: Synthetic peptide
  Seed: MDLVLKRCLLHLAVIGALLAVGATK (PMEL_HUMAN)
  Core: LKRCLLHLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MDLVXKRXLXHLXVIGALLAVGATK

SEQ ID NO: 332641 - protein, 25 aa, Artificial Sequence
  Description of Artificial Sequence: Synthetic peptide
  Seed: MDLVLKRCLLHLAVIGALLAVGATK (PMEL_HUMAN)
  Core: RCLLHLAVI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKXCLXHXAVXGALLAVGATK

SEQ ID NO: 332642 - protein, 25 aa, Artificial Sequence
  Description of Artificial Sequence: Synthetic peptide
  Seed: MDLVLKRCLLHLAVIGALLAVGATK (PMEL_HUMAN)
  Core: LAVIGALLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHXAVXGXLLXVGATK

SEQ ID NO: 332643 - protein, 25 aa, Artificial Sequence
  Description of Artificial Sequence: Synthetic peptide
  Seed: MDLVLKRCLLHLAVIGALLAVGATK (PMEL_HUMAN)
  Core: VIGALLAVG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHLAXIGXLXAVXATK

SEQ ID NO: 332644 - protein, 25 aa, Artificial Sequence
  Description of Artificial Sequence: Synthetic peptide
  Seed: MDLVLKRCLLHLAVIGALLAVGATK (PMEL_HUMAN)
  Core: IGALLAVGA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
MDLVLKRCLLHLAVXGAXLXVGXTK

SEQ ID NO: 332645 - protein, 13 aa, Artificial Sequence
  Description of Artificial Sequence: Synthetic peptide
  Seed: MEVTVYHRRGSRS (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRS

SEQ ID NO: 332646 - protein, 14 aa, Artificial Sequence
  Description of Artificial Sequence: Synthetic peptide
  Seed: MEVTVYHRRGSRSY (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSY

SEQ ID NO: 332647 - protein, 15 aa, Artificial Sequence
  Description of Artificial Sequence: Synthetic peptide
  Seed: MEVTVYHRRGSRSYV (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYV

SEQ ID NO: 332648 - protein, 15 aa, Artificial Sequence
  Description of Artificial Sequence: Synthetic peptide
  Seed: MEVTVYHRRGSRSYV (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXV

SEQ ID NO: 332649 - protein, 16 aa, Artificial Sequence
  Description of Artificial Sequence: Synthetic peptide
  Seed: MEVTVYHRRGSRSYVP (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVP

SEQ ID NO: 332650 - protein, 17 aa, Artificial Sequence
  Description of Artificial Sequence: Synthetic peptide
  Seed: MEVTVYHRRGSRSYVPL (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPL

SEQ ID NO: 332651 - protein, 17 aa, Artificial Sequence
  Description of Artificial Sequence: Synthetic peptide
  Seed: MEVTVYHRRGSRSYVPL (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPL

SEQ ID NO: 332652 - protein, 18 aa, Artificial Sequence
  Description of Artificial Sequence: Synthetic peptide
  Seed: MEVTVYHRRGSRSYVPLA (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLA

SEQ ID NO: 332653 - protein, 19 aa, Artificial Sequence
  Description of Artificial Sequence: Synthetic peptide
  Seed: MEVTVYHRRGSRSYVPLAH (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAH

SEQ ID NO: 332654 - protein, 19 aa, Artificial Sequence
  Description of Artificial Sequence: Synthetic peptide
  Seed: MEVTVYHRRGSRSYVPLAH (PMEL_HUMAN)
  Core: VYHRRGSRS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MEVTXYHXRXSRXYVPLAH

SEQ ID NO: 332655 - protein, 19 aa, Artificial Sequence
  Description of Artificial Sequence: Synthetic peptide
  Seed: MEVTVYHRRGSRSYVPLAH (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPLAH

SEQ ID NO: 332656 - protein, 19 aa, Artificial Sequence
  Description of Artificial Sequence: Synthetic peptide
  Seed: MEVTVYHRRGSRSYVPLAH (PMEL_HUMAN)
  Core: RRGSRSYVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHXRGXRXYVXLAH

SEQ ID NO: 332657 - protein, 20 aa, Artificial Sequence
  Description of Artificial Sequence: Synthetic peptide
  Seed: MEVTVYHRRGSRSYVPLAHS (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAHS

SEQ ID NO: 332658 - protein, 20 aa, Artificial Sequence
  Description of Artificial Sequence: Synthetic peptide
  Seed: MEVTVYHRRGSRSYVPLAHS (PMEL_HUMAN)
  Core: VYHRRGSRS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MEVTXYHXRXSRXYVPLAHS

SEQ ID NO: 332659 - protein, 20 aa, Artificial Sequence
  Description of Artificial Sequence: Synthetic peptide
  Seed: MEVTVYHRRGSRSYVPLAHS (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPLAHS

SEQ ID NO: 332660 - protein, 20 aa, Artificial Sequence
  Description of Artificial Sequence: Synthetic peptide
  Seed: MEVTVYHRRGSRSYVPLAHS (PMEL_HUMAN)
  Core: RGSRSYVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRXGSXSXVPXAHS

SEQ ID NO: 332661 - protein, 20 aa, Artificial Sequence
  Description of Artificial Sequence: Synthetic peptide
  Seed: MEVTVYHRRGSRSYVPLAHS (PMEL_HUMAN)
  Core: GSRSYVPLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRXSRXYXPLXHS

SEQ ID NO: 332662 - protein, 20 aa, Artificial Sequence
  Description of Artificial Sequence: Synthetic peptide
  Seed: MEVTVYHRRGSRSYVPLAHS (PMEL_HUMAN)
  Core: SRSYVPLAH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGXRSXVXLAXS

SEQ ID NO: 332663 - protein, 20 aa, Artificial Sequence
  Description of Artificial Sequence: Synthetic peptide
  Seed: MEVTVYHRRGSRSYVPLAHS (PMEL_HUMAN)
  Core: RSYVPLAHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSXSYXPXAHX

SEQ ID NO: 332664 - protein, 21 aa, Artificial Sequence
  Description of Artificial Sequence: Synthetic peptide
  Seed: MEVTVYHRRGSRSYVPLAHSS (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAHSS

SEQ ID NO: 332665 - protein, 21 aa, Artificial Sequence
  Description of Artificial Sequence: Synthetic peptide
  Seed: MEVTVYHRRGSRSYVPLAHSS (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPLAHSS

SEQ ID NO: 332666 - protein, 21 aa, Artificial Sequence
  Description of Artificial Sequence: Synthetic peptide
  Seed: MEVTVYHRRGSRSYVPLAHSS (PMEL_HUMAN)
  Core: GSRSYVPLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRXSRXYXPLXHSS

SEQ ID NO: 332667 - protein, 21 aa, Artificial Sequence
  Description of Artificial Sequence: Synthetic peptide
  Seed: MEVTVYHRRGSRSYVPLAHSS (PMEL_HUMAN)
  Core: SRSYVPLAH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGXRSXVXLAXSS

SEQ ID NO: 332668 - protein, 21 aa, Artificial Sequence
  Description of Artificial Sequence: Synthetic peptide
  Seed: MEVTVYHRRGSRSYVPLAHSS (PMEL_HUMAN)
  Core: RSYVPLAHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSXSYXPXAHXS

SEQ ID NO: 332669 - protein, 22 aa, Artificial Sequence
  Description of Artificial Sequence: Synthetic peptide
  Seed: MEVTVYHRRGSRSYVPLAHSSS (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAHSSS

SEQ ID NO: 332670 - protein, 22 aa, Artificial Sequence
  Description of Artificial Sequence: Synthetic peptide
  Seed: MEVTVYHRRGSRSYVPLAHSSS (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPLAHSSS

SEQ ID NO: 332671 - protein, 22 aa, Artificial Sequence
  Description of Artificial Sequence: Synthetic peptide
  Seed: MEVTVYHRRGSRSYVPLAHSSS (PMEL_HUMAN)
  Core: GSRSYVPLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRXSRXYXPLXHSSS

SEQ ID NO: 332672 - protein, 22 aa, Artificial Sequence
  Description of Artificial Sequence: Synthetic peptide
  Seed: MEVTVYHRRGSRSYVPLAHSSS (PMEL_HUMAN)
  Core: SRSYVPLAH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGXRSXVXLAXSSS

SEQ ID NO: 332673 - protein, 22 aa, Artificial Sequence
  Description of Artificial Sequence: Synthetic peptide
  Seed: MEVTVYHRRGSRSYVPLAHSSS (PMEL_HUMAN)
  Core: RSYVPLAHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSXSYXPXAHXSS

SEQ ID NO: 332674 - protein, 22 aa, Artificial Sequence
  Description of Artificial Sequence: Synthetic peptide
  Seed: MEVTVYHRRGSRSYVPLAHSSS (PMEL_HUMAN)
  Core: YVPLAHSSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSRSXVPXAXSSX

SEQ ID NO: 332675 - protein, 23 aa, Artificial Sequence
  Description of Artificial Sequence: Synthetic peptide
  Seed: MEVTVYHRRGSRSYVPLAHSSSA (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAHSSSA

SEQ ID NO: 332676 - protein, 23 aa, Artificial Sequence
  Description of Artificial Sequence: Synthetic peptide
  Seed: MEVTVYHRRGSRSYVPLAHSSSA (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPLAHSSSA

SEQ ID NO: 332677 - protein, 23 aa, Artificial Sequence
  Description of Artificial Sequence: Synthetic peptide
  Seed: MEVTVYHRRGSRSYVPLAHSSSA (PMEL_HUMAN)
  Core: GSRSYVPLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRXSRXYXPLXHSSSA

SEQ ID NO: 332678 - protein, 23 aa, Artificial Sequence
  Description of Artificial Sequence: Synthetic peptide
  Seed: MEVTVYHRRGSRSYVPLAHSSSA (PMEL_HUMAN)
  Core: SRSYVPLAH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGXRSXVXLAXSSSA

SEQ ID NO: 332679 - protein, 23 aa, Artificial Sequence
  Description of Artificial Sequence: Synthetic peptide
  Seed: MEVTVYHRRGSRSYVPLAHSSSA (PMEL_HUMAN)
  Core: RSYVPLAHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSXSYXPXAHXSSA

SEQ ID NO: 332680 - protein, 23 aa, Artificial Sequence
  Description of Artificial Sequence: Synthetic peptide
  Seed: MEVTVYHRRGSRSYVPLAHSSSA (PMEL_HUMAN)
  Core: YVPLAHSSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSRSXVPXAXSSXA

SEQ ID NO: 332681 - protein, 24 aa, Artificial Sequence
  Description of Artificial Sequence: Synthetic peptide
  Seed: MEVTVYHRRGSRSYVPLAHSSSAF (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAHSSSAF

SEQ ID NO: 332682 - protein, 24 aa, Artificial Sequence
  Description of Artificial Sequence: Synthetic peptide
  Seed: MEVTVYHRRGSRSYVPLAHSSSAF (PMEL_HUMAN)
  Core: YHRRGSRSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVXHRXGXRSXVPLAHSSSAF

SEQ ID NO: 332683 - protein, 24 aa, Artificial Sequence
  Description of Artificial Sequence: Synthetic peptide
  Seed: MEVTVYHRRGSRSYVPLAHSSSAF (PMEL_HUMAN)
  Core: GSRSYVPLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRXSRXYXPLXHSSSAF

SEQ ID NO: 332684 - protein, 24 aa, Artificial Sequence
  Description of Artificial Sequence: Synthetic peptide
  Seed: MEVTVYHRRGSRSYVPLAHSSSAF (PMEL_HUMAN)
  Core: SRSYVPLAH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGXRSXVXLAXSSSAF

SEQ ID NO: 332685 - protein, 24 aa, Artificial Sequence
  Description of Artificial Sequence: Synthetic peptide
  Seed: MEVTVYHRRGSRSYVPLAHSSSAF (PMEL_HUMAN)
  Core: RSYVPLAHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSXSYXPXAHXSSAF

SEQ ID NO: 332686 - protein, 24 aa, Artificial Sequence
  Description of Artificial Sequence: Synthetic peptide
  Seed: MEVTVYHRRGSRSYVPLAHSSSAF (PMEL_HUMAN)
  Core: YVPLAHSSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSRSXVPXAXSSXAF

SEQ ID NO: 332687 - protein, 25 aa, Artificial Sequence
  Description of Artificial Sequence: Synthetic peptide
  Seed: MEVTVYHRRGSRSYVPLAHSSSAFT (PMEL_HUMAN)
  Core: VTVYHRRGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
MEXTVXHXRGXRSYVPLAHSSSAFT

SEQ ID NO: 332688 - protein, 25 aa, Artificial Sequence
  Description of Artificial Sequence: Synthetic peptide
  Seed: MEVTVYHRRGSRSYVPLAHSSSAFT (PMEL_HUMAN)
  Core: GSRSYVPLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRXSRXYXPLXHSSSAFT

SEQ ID NO: 332689 - protein, 25 aa, Artificial Sequence
  Description of Artificial Sequence: Synthetic peptide
  Seed: MEVTVYHRRGSRSYVPLAHSSSAFT (PMEL_HUMAN)
  Core: SRSYVPLAH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGXRSXVXLAXSSSAFT

SEQ ID NO: 332690 - protein, 25 aa, Artificial Sequence
  Description of Artificial Sequence: Synthetic peptide
  Seed: MEVTVYHRRGSRSYVPLAHSSSAFT (PMEL_HUMAN)
  Core: RSYVPLAHS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSXSYXPXAHXSSAFT

SEQ ID NO: 332691 - protein, 25 aa, Artificial Sequence
  Description of Artificial Sequence: Synthetic peptide
  Seed: MEVTVYHRRGSRSYVPLAHSSSAFT (PMEL_HUMAN)
  Core: YVPLAHSSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MEVTVYHRRGSRSXVPXAXSSXAFT

SEQ ID NO: 332692 - protein, 14 aa, Artificial Sequence
  Description of Artificial Sequence: Synthetic peptide
  Seed: MGTTLAEMSTPEAT (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXT

SEQ ID NO: 332693 - protein, 14 aa, Artificial Sequence
  Description of Artificial Sequence: Synthetic peptide
  Seed: MGTTLAEMSTPEAT (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAX

SEQ ID NO: 332694 - protein, 15 aa, Artificial Sequence
  Description of Artificial Sequence: Synthetic peptide
  Seed: MGTTLAEMSTPEATG (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTG

SEQ ID NO: 332695 - protein, 15 aa, Artificial Sequence
  Description of Artificial Sequence: Synthetic peptide
  Seed: MGTTLAEMSTPEATG (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXG

SEQ ID NO: 332696 - protein, 16 aa, Artificial Sequence
  Description of Artificial Sequence: Synthetic peptide
  Seed: MGTTLAEMSTPEATGM (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGM

SEQ ID NO: 332697 - protein, 16 aa, Artificial Sequence
  Description of Artificial Sequence: Synthetic peptide
  Seed: MGTTLAEMSTPEATGM (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGM

SEQ ID NO: 332698 - protein, 17 aa, Artificial Sequence
  Description of Artificial Sequence: Synthetic peptide
  Seed: MGTTLAEMSTPEATGMT (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMT

SEQ ID NO: 332699 - protein, 17 aa, Artificial Sequence
  Description of Artificial Sequence: Synthetic peptide
  Seed: MGTTLAEMSTPEATGMT (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMT

SEQ ID NO: 332700 - protein, 18 aa, Artificial Sequence
  Description of Artificial Sequence: Synthetic peptide
  Seed: MGTTLAEMSTPEATGMTP (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTP

SEQ ID NO: 332701 - protein, 19 aa, Artificial Sequence
  Description of Artificial Sequence: Synthetic peptide
  Seed: MGTTLAEMSTPEATGMTPA (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPA

SEQ ID NO: 332702 - protein, 19 aa, Artificial Sequence
  Description of Artificial Sequence: Synthetic peptide
  Seed: MGTTLAEMSTPEATGMTPA (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTPA

SEQ ID NO: 332703 - protein, 20 aa, Artificial Sequence
  Description of Artificial Sequence: Synthetic peptide
  Seed: MGTTLAEMSTPEATGMTPAE (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPAE

SEQ ID NO: 332704 - protein, 20 aa, Artificial Sequence
  Description of Artificial Sequence: Synthetic peptide
  Seed: MGTTLAEMSTPEATGMTPAE (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTPAE

SEQ ID NO: 332705 - protein, 21 aa, Artificial Sequence
  Description of Artificial Sequence: Synthetic peptide
  Seed: MGTTLAEMSTPEATGMTPAEV (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPAEV

SEQ ID NO: 332706 - protein, 21 aa, Artificial Sequence
  Description of Artificial Sequence: Synthetic peptide
  Seed: MGTTLAEMSTPEATGMTPAEV (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTPAEV

SEQ ID NO: 332707 - protein, 22 aa, Artificial Sequence
  Description of Artificial Sequence: Synthetic peptide
  Seed: MGTTLAEMSTPEATGMTPAEVS (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPAEVS

SEQ ID NO: 332708 - protein, 22 aa, Artificial Sequence
  Description of Artificial Sequence: Synthetic peptide
  Seed: MGTTLAEMSTPEATGMTPAEVS (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTPAEVS

SEQ ID NO: 332709 - protein, 22 aa, Artificial Sequence
  Description of Artificial Sequence: Synthetic peptide
  Seed: MGTTLAEMSTPEATGMTPAEVS (PMEL_HUMAN)
  Core: ATGMTPAEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLAEMSTPEXTGXTXAEXS

SEQ ID NO: 332710 - protein, 23 aa, Artificial Sequence
  Description of Artificial Sequence: Synthetic peptide
  Seed: MGTTLAEMSTPEATGMTPAEVSI (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPAEVSI

SEQ ID NO: 332711 - protein, 23 aa, Artificial Sequence
  Description of Artificial Sequence: Synthetic peptide
  Seed: MGTTLAEMSTPEATGMTPAEVSI (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTPAEVSI

SEQ ID NO: 332712 - protein, 23 aa, Artificial Sequence
  Description of Artificial Sequence: Synthetic peptide
  Seed: MGTTLAEMSTPEATGMTPAEVSI (PMEL_HUMAN)
  Core: ATGMTPAEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLAEMSTPEXTGXTXAEXSI

SEQ ID NO: 332713 - protein, 24 aa, Artificial Sequence
  Description of Artificial Sequence: Synthetic peptide
  Seed: MGTTLAEMSTPEATGMTPAEVSIV (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPAEVSIV

SEQ ID NO: 332714 - protein, 24 aa, Artificial Sequence
  Description of Artificial Sequence: Synthetic peptide
  Seed: MGTTLAEMSTPEATGMTPAEVSIV (PMEL_HUMAN)
  Core: AEMSTPEAT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLXEMXTXEAXGMTPAEVSIV

SEQ ID NO: 332715 - protein, 24 aa, Artificial Sequence
  Description of Artificial Sequence: Synthetic peptide
  Seed: MGTTLAEMSTPEATGMTPAEVSIV (PMEL_HUMAN)
  Core: EATGMTPAE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLAEMSTPXATXMXPAXVSIV

SEQ ID NO: 332716 - protein, 24 aa, Artificial Sequence
  Description of Artificial Sequence: Synthetic peptide
  Seed: MGTTLAEMSTPEATGMTPAEVSIV (PMEL_HUMAN)
  Core: ATGMTPAEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLAEMSTPEXTGXTXAEXSIV

SEQ ID NO: 332717 - protein, 25 aa, Artificial Sequence
  Description of Artificial Sequence: Synthetic peptide
  Seed: MGTTLAEMSTPEATGMTPAEVSIVV (PMEL_HUMAN)
  Core: LAEMSTPEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MGTTXAEXSXPEXTGMTPAEVSIVV

SEQ ID NO: 332718 - protein, 25 aa, Artificial Sequence
  Description of Artificial Sequence: Synthetic peptide
  Seed: MGTTLAEMSTPEATGMTPAEVSIVV (PMEL_HUMAN)
  Core: EATGMTPAE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLAEMSTPXATXMXPAXVSIVV

SEQ ID NO: 332719 - protein, 25 aa, Artificial Sequence
  Description of Artificial Sequence: Synthetic peptide
  Seed: MGTTLAEMSTPEATGMTPAEVSIVV (PMEL_HUMAN)
  Core: ATGMTPAEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MGTTLAEMSTPEXTGXTXAEXSIVV

SEQ ID NO: 332720 - protein, 20 aa, Artificial Sequence
  Description of Artificial Sequence: Synthetic peptide
  Seed: MKQDFSVPQLPHSSSHWLRL (PMEL_HUMAN)
  Core: FSVPQLPHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MKQDXSVXQXPHXSSHWLRL

SEQ ID NO: 332721 - protein, 20 aa, Artificial Sequence
  Description of Artificial Sequence: Synthetic peptide
  Seed: MKQDFSVPQLPHSSSHWLRL (PMEL_HUMAN)
  Core: LPHSSSHWL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQXPHXSXHWXRL

SEQ ID NO: 332722 - protein, 21 aa, Artificial Sequence
  Description of Artificial Sequence: Synthetic peptide
  Seed: MKQDFSVPQLPHSSSHWLRLP (PMEL_HUMAN)
  Core: FSVPQLPHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MKQDXSVXQXPHXSSHWLRLP

SEQ ID NO: 332723 - protein, 21 aa, Artificial Sequence
  Description of Artificial Sequence: Synthetic peptide
  Seed: MKQDFSVPQLPHSSSHWLRLP (PMEL_HUMAN)
  Core: HSSSHWLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLPXSSXHXLRXP

SEQ ID NO: 332724 - protein, 22 aa, Artificial Sequence
  Description of Artificial Sequence: Synthetic peptide
  Seed: MKQDFSVPQLPHSSSHWLRLPR (PMEL_HUMAN)
  Core: FSVPQLPHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MKQDXSVXQXPHXSSHWLRLPR

SEQ ID NO: 332725 - protein, 22 aa, Artificial Sequence
  Description of Artificial Sequence: Synthetic peptide
  Seed: MKQDFSVPQLPHSSSHWLRLPR (PMEL_HUMAN)
  Core: HSSSHWLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLPXSSXHXLRXPR

SEQ ID NO: 332726 - protein, 23 aa, Artificial Sequence
  Description of Artificial Sequence: Synthetic peptide
  Seed: MKQDFSVPQLPHSSSHWLRLPRI (PMEL_HUMAN)
  Core: MKQDFSVPQ
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XKQXFXVPXLPHSSSHWLRLPRI

SEQ ID NO: 332727 - protein, 23 aa, Artificial Sequence
  Description of Artificial Sequence: Synthetic peptide
  Seed: MKQDFSVPQLPHSSSHWLRLPRI (PMEL_HUMAN)
  Core: FSVPQLPHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MKQDXSVXQXPHXSSHWLRLPRI

SEQ ID NO: 332728 - protein, 23 aa, Artificial Sequence
  Description of Artificial Sequence: Synthetic peptide
  Seed: MKQDFSVPQLPHSSSHWLRLPRI (PMEL_HUMAN)
  Core: LPHSSSHWL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQXPHXSXHWXRLPRI

SEQ ID NO: 332729 - protein, 23 aa, Artificial Sequence
  Description of Artificial Sequence: Synthetic peptide
  Seed: MKQDFSVPQLPHSSSHWLRLPRI (PMEL_HUMAN)
  Core: PHSSSHWLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLXHSXSXWLXLPRI

SEQ ID NO: 332730 - protein, 23 aa, Artificial Sequence
  Description of Artificial Sequence: Synthetic peptide
  Seed: MKQDFSVPQLPHSSSHWLRLPRI (PMEL_HUMAN)
  Core: HSSSHWLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLPXSSXHXLRXPRI

SEQ ID NO: 332731 - protein, 24 aa, Artificial Sequence
  Description of Artificial Sequence: Synthetic peptide
  Seed: MKQDFSVPQLPHSSSHWLRLPRIF (PMEL_HUMAN)
  Core: MKQDFSVPQ
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XKQXFXVPXLPHSSSHWLRLPRIF

SEQ ID NO: 332732 - protein, 24 aa, Artificial Sequence
  Description of Artificial Sequence: Synthetic peptide
  Seed: MKQDFSVPQLPHSSSHWLRLPRIF (PMEL_HUMAN)
  Core: FSVPQLPHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MKQDXSVXQXPHXSSHWLRLPRIF

SEQ ID NO: 332733 - protein, 24 aa, Artificial Sequence
  Description of Artificial Sequence: Synthetic peptide
  Seed: MKQDFSVPQLPHSSSHWLRLPRIF (PMEL_HUMAN)
  Core: LPHSSSHWL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQXPHXSXHWXRLPRIF

SEQ ID NO: 332734 - protein, 24 aa, Artificial Sequence
  Description of Artificial Sequence: Synthetic peptide
  Seed: MKQDFSVPQLPHSSSHWLRLPRIF (PMEL_HUMAN)
  Core: PHSSSHWLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLXHSXSXWLXLPRIF

SEQ ID NO: 332735 - protein, 24 aa, Artificial Sequence
  Description of Artificial Sequence: Synthetic peptide
  Seed: MKQDFSVPQLPHSSSHWLRLPRIF (PMEL_HUMAN)
  Core: HSSSHWLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLPXSSXHXLRXPRIF

SEQ ID NO: 332736 - protein, 25 aa, Artificial Sequence
  Description of Artificial Sequence: Synthetic peptide
  Seed: MKQDFSVPQLPHSSSHWLRLPRIFC (PMEL_HUMAN)
  Core: MKQDFSVPQ
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XKQXFXVPXLPHSSSHWLRLPRIFC

SEQ ID NO: 332737 - protein, 25 aa, Artificial Sequence
  Description of Artificial Sequence: Synthetic peptide
  Seed: MKQDFSVPQLPHSSSHWLRLPRIFC (PMEL_HUMAN)
  Core: FSVPQLPHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MKQDXSVXQXPHXSSHWLRLPRIFC

SEQ ID NO: 332738 - protein, 25 aa, Artificial Sequence
  Description of Artificial Sequence: Synthetic peptide
  Seed: MKQDFSVPQLPHSSSHWLRLPRIFC (PMEL_HUMAN)
  Core: LPHSSSHWL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQXPHXSXHWXRLPRIFC

SEQ ID NO: 332739 - protein, 25 aa, Artificial Sequence
  Description of Artificial Sequence: Synthetic peptide
  Seed: MKQDFSVPQLPHSSSHWLRLPRIFC (PMEL_HUMAN)
  Core: PHSSSHWLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLXHSXSXWLXLPRIFC

SEQ ID NO: 332740 - protein, 25 aa, Artificial Sequence
  Description of Artificial Sequence: Synthetic peptide
  Seed: MKQDFSVPQLPHSSSHWLRLPRIFC (PMEL_HUMAN)
  Core: HSSSHWLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MKQDFSVPQLPXSSXHXLRXPRIFC

SEQ ID NO: 332741 - protein, 14 aa, Artificial Sequence
  Description of Artificial Sequence: Synthetic peptide
  Seed: MLGTHTMEVTVYHR (PMEL_HUMAN)
  Core: THTMEVTVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MLGXHTXEXTVXHR

SEQ ID NO: 332742 - protein, 15 aa, Artificial Sequence
  Description of Artificial Sequence: Synthetic peptide
  Seed: MLGTHTMEVTVYHRR (PMEL_HUMAN)
  Core: THTMEVTVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MLGXHTXEXTVXHRR

SEQ ID NO: 332743 - protein, 15 aa, Artificial Sequence
  Description of Artificial Sequence: Synthetic peptide
  Seed: MLGTHTMEVTVYHRR (PMEL_HUMAN)
  Core: HTMEVTVYH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MLGTXTMXVXVYXRR

SEQ ID NO: 332744 - protein, 15 aa, Artificial Sequence
  Description of Artificial Sequence: Synthetic peptide
  Seed: MLGTHTMEVTVYHRR (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRX

SEQ ID NO: 332745 - protein, 16 aa, Artificial Sequence
  Description of Artificial Sequence: Synthetic peptide
  Seed: MLGTHTMEVTVYHRRG (PMEL_HUMAN)
  Core: THTMEVTVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MLGXHTXEXTVXHRRG

SEQ ID NO: 332746 - protein, 16 aa, Artificial Sequence
  Description of Artificial Sequence: Synthetic peptide
  Seed: MLGTHTMEVTVYHRRG (PMEL_HUMAN)
  Core: HTMEVTVYH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MLGTXTMXVXVYXRRG

SEQ ID NO: 332747 - protein, 16 aa, Artificial Sequence
  Description of Artificial Sequence: Synthetic peptide
  Seed: MLGTHTMEVTVYHRRG (PMEL_HUMAN)
  Core: TMEVTVYHR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHXMEXTXYHXRG

SEQ ID NO: 332748 - protein, 16 aa, Artificial Sequence
  Description of Artificial Sequence: Synthetic peptide
  Seed: MLGTHTMEVTVYHRRG (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRXG

SEQ ID NO: 332749 - protein, 17 aa, Artificial Sequence
  Description of Artificial Sequence: Synthetic peptide
  Seed: MLGTHTMEVTVYHRRGS (PMEL_HUMAN)
  Core: THTMEVTVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MLGXHTXEXTVXHRRGS

SEQ ID NO: 332750 - protein, 17 aa, Artificial Sequence
  Description of Artificial Sequence: Synthetic peptide
  Seed: MLGTHTMEVTVYHRRGS (PMEL_HUMAN)
  Core: HTMEVTVYH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MLGTXTMXVXVYXRRGS

SEQ ID NO: 332751 - protein, 17 aa, Artificial Sequence
  Description of Artificial Sequence: Synthetic peptide
  Seed: MLGTHTMEVTVYHRRGS (PMEL_HUMAN)
  Core: TMEVTVYHR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHXMEXTXYHXRGS

SEQ ID NO: 332752 - protein, 17 aa, Artificial Sequence
  Description of Artificial Sequence: Synthetic peptide
  Seed: MLGTHTMEVTVYHRRGS (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRXGS

SEQ ID NO: 332753 - protein, 17 aa, Artificial Sequence
  Description of Artificial Sequence: Synthetic peptide
  Seed: MLGTHTMEVTVYHRRGS (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGX

SEQ ID NO: 332754 - protein, 18 aa, Artificial Sequence
  Description of Artificial Sequence: Synthetic peptide
  Seed: MLGTHTMEVTVYHRRGSR (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXR

SEQ ID NO: 332755 - protein, 19 aa, Artificial Sequence
  Description of Artificial Sequence: Synthetic peptide
  Seed: MLGTHTMEVTVYHRRGSRS (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRS

SEQ ID NO: 332756 - protein, 20 aa, Artificial Sequence
  Description of Artificial Sequence: Synthetic peptide
  Seed: MLGTHTMEVTVYHRRGSRSY (PMEL_HUMAN)
  Core: THTMEVTVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MLGXHTXEXTVXHRRGSRSY

SEQ ID NO: 332757 - protein, 20 aa, Artificial Sequence
  Description of Artificial Sequence: Synthetic peptide
  Seed: MLGTHTMEVTVYHRRGSRSY (PMEL_HUMAN)
  Core: TMEVTVYHR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHXMEXTXYHXRGSRSY

SEQ ID NO: 332758 - protein, 20 aa, Artificial Sequence
  Description of Artificial Sequence: Synthetic peptide
  Seed: MLGTHTMEVTVYHRRGSRSY (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRXGSRSY

SEQ ID NO: 332759 - protein, 20 aa, Artificial Sequence
  Description of Artificial Sequence: Synthetic peptide
  Seed: MLGTHTMEVTVYHRRGSRSY (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRSY

SEQ ID NO: 332760 - protein, 21 aa, Artificial Sequence
  Description of Artificial Sequence: Synthetic peptide
  Seed: MLGTHTMEVTVYHRRGSRSYV (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRSYV

SEQ ID NO: 332761 - protein, 22 aa, Artificial Sequence
  Description of Artificial Sequence: Synthetic peptide
  Seed: MLGTHTMEVTVYHRRGSRSYVP (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRSYVP

SEQ ID NO: 332762 - protein, 23 aa, Artificial Sequence
  Description of Artificial Sequence: Synthetic peptide
  Seed: MLGTHTMEVTVYHRRGSRSYVPL (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRXGSRSYVPL

SEQ ID NO: 332763 - protein, 23 aa, Artificial Sequence
  Description of Artificial Sequence: Synthetic peptide
  Seed: MLGTHTMEVTVYHRRGSRSYVPL (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRSYVPL

SEQ ID NO: 332764 - protein, 23 aa, Artificial Sequence
  Description of Artificial Sequence: Synthetic peptide
  Seed: MLGTHTMEVTVYHRRGSRSYVPL (PMEL_HUMAN)
  Core: YHRRGSRSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEVTVXHRXGXRSXVPL

SEQ ID NO: 332765 - protein, 24 aa, Artificial Sequence
  Description of Artificial Sequence: Synthetic peptide
  Seed: MLGTHTMEVTVYHRRGSRSYVPLA (PMEL_HUMAN)
  Core: TMEVTVYHR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHXMEXTXYHXRGSRSYVPLA

SEQ ID NO: 332766 - protein, 24 aa, Artificial Sequence
  Description of Artificial Sequence: Synthetic peptide
  Seed: MLGTHTMEVTVYHRRGSRSYVPLA (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRXGSRSYVPLA

SEQ ID NO: 332767 - protein, 24 aa, Artificial Sequence
  Description of Artificial Sequence: Synthetic peptide
  Seed: MLGTHTMEVTVYHRRGSRSYVPLA (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRSYVPLA

SEQ ID NO: 332768 - protein, 24 aa, Artificial Sequence
  Description of Artificial Sequence: Synthetic peptide
  Seed: MLGTHTMEVTVYHRRGSRSYVPLA (PMEL_HUMAN)
  Core: YHRRGSRSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEVTVXHRXGXRSXVPLA

SEQ ID NO: 332769 - protein, 25 aa, Artificial Sequence
  Description of Artificial Sequence: Synthetic peptide
  Seed: MLGTHTMEVTVYHRRGSRSYVPLAH (PMEL_HUMAN)
  Core: THTMEVTVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MLGXHTXEXTVXHRRGSRSYVPLAH

SEQ ID NO: 332770 - protein, 25 aa, Artificial Sequence
  Description of Artificial Sequence: Synthetic peptide
  Seed: MLGTHTMEVTVYHRRGSRSYVPLAH (PMEL_HUMAN)
  Core: MEVTVYHRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTXEVXVXHRXGSRSYVPLAH

SEQ ID NO: 332771 - protein, 25 aa, Artificial Sequence
  Description of Artificial Sequence: Synthetic peptide
  Seed: MLGTHTMEVTVYHRRGSRSYVPLAH (PMEL_HUMAN)
  Core: VTVYHRRGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEXTVXHXRGXRSYVPLAH

SEQ ID NO: 332772 - protein, 25 aa, Artificial Sequence
  Description of Artificial Sequence: Synthetic peptide
  Seed: MLGTHTMEVTVYHRRGSRSYVPLAH (PMEL_HUMAN)
  Core: YHRRGSRSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEVTVXHRXGXRSXVPLAH

SEQ ID NO: 332773 - protein, 25 aa, Artificial Sequence
  Description of Artificial Sequence: Synthetic peptide
  Seed: MLGTHTMEVTVYHRRGSRSYVPLAH (PMEL_HUMAN)
  Core: RRGSRSYVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEVTVYHXRGXRXYVXLAH

SEQ ID NO: 332774 - protein, 25 aa, Artificial Sequence
  Description of Artificial Sequence: Synthetic peptide
  Seed: MLGTHTMEVTVYHRRGSRSYVPLAH (PMEL_HUMAN)
  Core: GSRSYVPLA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
MLGTHTMEVTVYHRRXSRXYXPLXH

SEQ ID NO: 332775 - protein, 14 aa, Artificial Sequence
  Description of Artificial Sequence: Synthetic peptide
  Seed: MPGQEAGLGQVPLI (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLX

SEQ ID NO: 332776 - protein, 15 aa, Artificial Sequence
  Description of Artificial Sequence: Synthetic peptide
  Seed: MPGQEAGLGQVPLIV (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXV

SEQ ID NO: 332777 - protein, 16 aa, Artificial Sequence
  Description of Artificial Sequence: Synthetic peptide
  Seed: MPGQEAGLGQVPLIVG (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVG

SEQ ID NO: 332778 - protein, 17 aa, Artificial Sequence
  Description of Artificial Sequence: Synthetic peptide
  Seed: MPGQEAGLGQVPLIVGI (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGI

SEQ ID NO: 332779 - protein, 19 aa, Artificial Sequence
  Description of Artificial Sequence: Synthetic peptide
  Seed: MPGQEAGLGQVPLIVGILL (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILL

SEQ ID NO: 332780 - protein, 19 aa, Artificial Sequence
  Description of Artificial Sequence: Synthetic peptide
  Seed: MPGQEAGLGQVPLIVGILL (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILL

SEQ ID NO: 332781 - protein, 19 aa, Artificial Sequence
  Description of Artificial Sequence: Synthetic peptide
  Seed: MPGQEAGLGQVPLIVGILL (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILL

SEQ ID NO: 332782 - protein, 20 aa, Artificial Sequence
  Description of Artificial Sequence: Synthetic peptide
  Seed: MPGQEAGLGQVPLIVGILLV (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILLV

SEQ ID NO: 332783 - protein, 20 aa, Artificial Sequence
  Description of Artificial Sequence: Synthetic peptide
  Seed: MPGQEAGLGQVPLIVGILLV (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILLV

SEQ ID NO: 332784 - protein, 20 aa, Artificial Sequence
  Description of Artificial Sequence: Synthetic peptide
  Seed: MPGQEAGLGQVPLIVGILLV (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILLV

SEQ ID NO: 332785 - protein, 21 aa, Artificial Sequence
  Description of Artificial Sequence: Synthetic peptide
  Seed: MPGQEAGLGQVPLIVGILLVL (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILLVL

SEQ ID NO: 332786 - protein, 21 aa, Artificial Sequence
  Description of Artificial Sequence: Synthetic peptide
  Seed: MPGQEAGLGQVPLIVGILLVL (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILLVL

SEQ ID NO: 332787 - protein, 21 aa, Artificial Sequence
  Description of Artificial Sequence: Synthetic peptide
  Seed: MPGQEAGLGQVPLIVGILLVL (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILLVL

SEQ ID NO: 332788 - protein, 22 aa, Artificial Sequence
  Description of Artificial Sequence: Synthetic peptide
  Seed: MPGQEAGLGQVPLIVGILLVLM (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILLVLM

SEQ ID NO: 332789 - protein, 22 aa, Artificial Sequence
  Description of Artificial Sequence: Synthetic peptide
  Seed: MPGQEAGLGQVPLIVGILLVLM (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILLVLM

SEQ ID NO: 332790 - protein, 22 aa, Artificial Sequence
  Description of Artificial Sequence: Synthetic peptide
  Seed: MPGQEAGLGQVPLIVGILLVLM (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILLVLM

SEQ ID NO: 332791 - protein, 23 aa, Artificial Sequence
  Description of Artificial Sequence: Synthetic peptide
  Seed: MPGQEAGLGQVPLIVGILLVLMA (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILLVLMA

SEQ ID NO: 332792 - protein, 23 aa, Artificial Sequence
  Description of Artificial Sequence: Synthetic peptide
  Seed: MPGQEAGLGQVPLIVGILLVLMA (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILLVLMA

SEQ ID NO: 332793 - protein, 23 aa, Artificial Sequence
  Description of Artificial Sequence: Synthetic peptide
  Seed: MPGQEAGLGQVPLIVGILLVLMA (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILLVLMA

SEQ ID NO: 332794 - protein, 23 aa, Artificial Sequence
  Description of Artificial Sequence: Synthetic peptide
  Seed: MPGQEAGLGQVPLIVGILLVLMA (PMEL_HUMAN)
  Core: LIVGILLVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGLGQVPXIVXIXLVXMA

SEQ ID NO: 332795 - protein, 24 aa, Artificial Sequence
  Description of Artificial Sequence: Synthetic peptide
  Seed: MPGQEAGLGQVPLIVGILLVLMAV (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILLVLMAV

SEQ ID NO: 332796 - protein, 24 aa, Artificial Sequence
  Description of Artificial Sequence: Synthetic peptide
  Seed: MPGQEAGLGQVPLIVGILLVLMAV (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILLVLMAV

SEQ ID NO: 332797 - protein, 24 aa, Artificial Sequence
  Description of Artificial Sequence: Synthetic peptide
  Seed: MPGQEAGLGQVPLIVGILLVLMAV (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILLVLMAV

SEQ ID NO: 332798 - protein, 24 aa, Artificial Sequence
  Description of Artificial Sequence: Synthetic peptide
  Seed: MPGQEAGLGQVPLIVGILLVLMAV (PMEL_HUMAN)
  Core: LIVGILLVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGLGQVPXIVXIXLVXMAV

SEQ ID NO: 332799 - protein, 25 aa, Artificial Sequence
  Description of Artificial Sequence: Synthetic peptide
  Seed: MPGQEAGLGQVPLIVGILLVLMAVV (PMEL_HUMAN)
  Core: AGLGQVPLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEXGLXQXPLXVGILLVLMAVV

SEQ ID NO: 332800 - protein, 25 aa, Artificial Sequence
  Description of Artificial Sequence: Synthetic peptide
  Seed: MPGQEAGLGQVPLIVGILLVLMAVV (PMEL_HUMAN)
  Core: GLGQVPLIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAXLGXVXLIXGILLVLMAVV

SEQ ID NO: 332801 - protein, 25 aa, Artificial Sequence
  Description of Artificial Sequence: Synthetic peptide
  Seed: MPGQEAGLGQVPLIVGILLVLMAVV (PMEL_HUMAN)
  Core: LGQVPLIVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGXGQXPXIVXILLVLMAVV

SEQ ID NO: 332802 - protein, 25 aa, Artificial Sequence
  Description of Artificial Sequence: Synthetic peptide
  Seed: MPGQEAGLGQVPLIVGILLVLMAVV (PMEL_HUMAN)
  Core: LIVGILLVL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGLGQVPXIVXIXLVXMAVV

SEQ ID NO: 332803 - protein, 25 aa, Artificial Sequence
  Description of Artificial Sequence: Synthetic peptide
  Seed: MPGQEAGLGQVPLIVGILLVLMAVV (PMEL_HUMAN)
  Core: IVGILLVLM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MPGQEAGLGQVPLXVGXLXVLXAVV

SEQ ID NO: 332804 - protein, 15 aa, Artificial Sequence
  Description of Artificial Sequence: Synthetic peptide
  Seed: MPTAESTGMTPEKVP (PMEL_HUMAN)
  Core: STGMTPEKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPTAEXTGXTXEKXP

SEQ ID NO: 332805 - protein, 16 aa, Artificial Sequence
  Description of Artificial Sequence: Synthetic peptide
  Seed: MPTAESTGMTPEKVPV (PMEL_HUMAN)
  Core: STGMTPEKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPTAEXTGXTXEKXPV

SEQ ID NO: 332806 - protein, 20 aa, Artificial Sequence
  Description of Artificial Sequence: Synthetic peptide
  Seed: MPTAESTGMTPEKVPVSEVM (PMEL_HUMAN)
  Core: STGMTPEKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MPTAEXTGXTXEKXPVSEVM

SEQ ID NO: 332807 - protein, 14 aa, Artificial Sequence
  Description of Artificial Sequence: Synthetic peptide
  Seed: MSTESITGSLGPLL (PMEL_HUMAN)
  Core: SITGSLGPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MSTEXITXSXGPXL

SEQ ID NO: 332808 - protein, 14 aa, Artificial Sequence
  Description of Artificial Sequence: Synthetic peptide
  Seed: MSTESITGSLGPLL (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLX

SEQ ID NO: 332809 - protein, 15 aa, Artificial Sequence
  Description of Artificial Sequence: Synthetic peptide
  Seed: MSTESITGSLGPLLD (PMEL_HUMAN)
  Core: SITGSLGPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MSTEXITXSXGPXLD

SEQ ID NO: 332810 - protein, 15 aa, Artificial Sequence
  Description of Artificial Sequence: Synthetic peptide
  Seed: MSTESITGSLGPLLD (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXD

SEQ ID NO: 332811 - protein, 16 aa, Artificial Sequence
  Description of Artificial Sequence: Synthetic peptide
  Seed: MSTESITGSLGPLLDG (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDG

SEQ ID NO: 332812 - protein, 17 aa, Artificial Sequence
  Description of Artificial Sequence: Synthetic peptide
  Seed: MSTESITGSLGPLLDGT (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGT

SEQ ID NO: 332813 - protein, 19 aa, Artificial Sequence
  Description of Artificial Sequence: Synthetic peptide
  Seed: MSTESITGSLGPLLDGTAT (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTAT

SEQ ID NO: 332814 - protein, 20 aa, Artificial Sequence
  Description of Artificial Sequence: Synthetic peptide
  Seed: MSTESITGSLGPLLDGTATL (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTATL

SEQ ID NO: 332815 - protein, 21 aa, Artificial Sequence
  Description of Artificial Sequence: Synthetic peptide
  Seed: MSTESITGSLGPLLDGTATLR (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTATLR

SEQ ID NO: 332816 - protein, 22 aa, Artificial Sequence
  Description of Artificial Sequence: Synthetic peptide
  Seed: MSTESITGSLGPLLDGTATLRL (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTATLRL

SEQ ID NO: 332817 - protein, 23 aa, Artificial Sequence
  Description of Artificial Sequence: Synthetic peptide
  Seed: MSTESITGSLGPLLDGTATLRLV (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTATLRLV

SEQ ID NO: 332818 - protein, 23 aa, Artificial Sequence
  Description of Artificial Sequence: Synthetic peptide
  Seed: MSTESITGSLGPLLDGTATLRLV (PMEL_HUMAN)
  Core: LGPLLDGTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MSTESITGSXGPXLXGTXTLRLV

SEQ ID NO: 332819 - protein, 23 aa, Artificial Sequence
  Description of Artificial Sequence: Synthetic peptide
  Seed: MSTESITGSLGPLLDGTATLRLV (PMEL_HUMAN)
  Core: LDGTATLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MSTESITGSLGPLXDGXAXLRXV

SEQ ID NO: 332820 - protein, 24 aa, Artificial Sequence
  Description of Artificial Sequence: Synthetic peptide
  Seed: MSTESITGSLGPLLDGTATLRLVK (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTATLRLVK

SEQ ID NO: 332821 - protein, 24 aa, Artificial Sequence
  Description of Artificial Sequence: Synthetic peptide
  Seed: MSTESITGSLGPLLDGTATLRLVK (PMEL_HUMAN)
  Core: LGPLLDGTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MSTESITGSXGPXLXGTXTLRLVK

SEQ ID NO: 332822 - protein, 24 aa, Artificial Sequence
  Description of Artificial Sequence: Synthetic peptide
  Seed: MSTESITGSLGPLLDGTATLRLVK (PMEL_HUMAN)
  Core: LDGTATLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MSTESITGSLGPLXDGXAXLRXVK

SEQ ID NO: 332823 - protein, 25 aa, Artificial Sequence
  Description of Artificial Sequence: Synthetic peptide
  Seed: MSTESITGSLGPLLDGTATLRLVKR (PMEL_HUMAN)
  Core: ITGSLGPLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTESXTGXLXPLXDGTATLRLVKR

SEQ ID NO: 332824 - protein, 25 aa, Artificial Sequence
  Description of Artificial Sequence: Synthetic peptide
  Seed: MSTESITGSLGPLLDGTATLRLVKR (PMEL_HUMAN)
  Core: LGPLLDGTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MSTESITGSXGPXLXGTXTLRLVKR

SEQ ID NO: 332825 - protein, 25 aa, Artificial Sequence
  Description of Artificial Sequence: Synthetic peptide
  Seed: MSTESITGSLGPLLDGTATLRLVKR (PMEL_HUMAN)
  Core: LDGTATLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MSTESITGSLGPLXDGXAXLRXVKR

SEQ ID NO: 332826 - protein, 14 aa, Artificial Sequence
  Description of Artificial Sequence: Synthetic peptide
  Seed: MSTPEATGMTPAEV (PMEL_HUMAN)
  Core: EATGMTPAE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MSTPXATXMXPAXV

SEQ ID NO: 332827 - protein, 14 aa, Artificial Sequence
  Description of Artificial Sequence: Synthetic peptide
  Seed: MSTPEATGMTPAEV (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEX

SEQ ID NO: 332828 - protein, 15 aa, Artificial Sequence
  Description of Artificial Sequence: Synthetic peptide
  Seed: MSTPEATGMTPAEVS (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXS

SEQ ID NO: 332829 - protein, 16 aa, Artificial Sequence
  Description of Artificial Sequence: Synthetic peptide
  Seed: MSTPEATGMTPAEVSI (PMEL_HUMAN)
  Core: EATGMTPAE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MSTPXATXMXPAXVSI

SEQ ID NO: 332830 - protein, 16 aa, Artificial Sequence
  Description of Artificial Sequence: Synthetic peptide
  Seed: MSTPEATGMTPAEVSI (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSI

SEQ ID NO: 332831 - protein, 17 aa, Artificial Sequence
  Description of Artificial Sequence: Synthetic peptide
  Seed: MSTPEATGMTPAEVSIV (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIV

SEQ ID NO: 332832 - protein, 18 aa, Artificial Sequence
  Description of Artificial Sequence: Synthetic peptide
  Seed: MSTPEATGMTPAEVSIVV (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVV

SEQ ID NO: 332833 - protein, 18 aa, Artificial Sequence
  Description of Artificial Sequence: Synthetic peptide
  Seed: MSTPEATGMTPAEVSIVV (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXV

SEQ ID NO: 332834 - protein, 19 aa, Artificial Sequence
  Description of Artificial Sequence: Synthetic peptide
  Seed: MSTPEATGMTPAEVSIVVL (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVL

SEQ ID NO: 332835 - protein, 19 aa, Artificial Sequence
  Description of Artificial Sequence: Synthetic peptide
  Seed: MSTPEATGMTPAEVSIVVL (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVL

SEQ ID NO: 332836 - protein, 20 aa, Artificial Sequence
  Description of Artificial Sequence: Synthetic peptide
  Seed: MSTPEATGMTPAEVSIVVLS (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVLS

SEQ ID NO: 332837 - protein, 20 aa, Artificial Sequence
  Description of Artificial Sequence: Synthetic peptide
  Seed: MSTPEATGMTPAEVSIVVLS (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVLS

SEQ ID NO: 332838 - protein, 21 aa, Artificial Sequence
  Description of Artificial Sequence: Synthetic peptide
  Seed: MSTPEATGMTPAEVSIVVLSG (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVLSG

SEQ ID NO: 332839 - protein, 21 aa, Artificial Sequence
  Description of Artificial Sequence: Synthetic peptide
  Seed: MSTPEATGMTPAEVSIVVLSG (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVLSG

SEQ ID NO: 332840 - protein, 22 aa, Artificial Sequence
  Description of Artificial Sequence: Synthetic peptide
  Seed: MSTPEATGMTPAEVSIVVLSGT (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVLSGT

SEQ ID NO: 332841 - protein, 22 aa, Artificial Sequence
  Description of Artificial Sequence: Synthetic peptide
  Seed: MSTPEATGMTPAEVSIVVLSGT (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVLSGT

SEQ ID NO: 332842 - protein, 23 aa, Artificial Sequence
  Description of Artificial Sequence: Synthetic peptide
  Seed: MSTPEATGMTPAEVSIVVLSGTT (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVLSGTT

SEQ ID NO: 332843 - protein, 23 aa, Artificial Sequence
  Description of Artificial Sequence: Synthetic peptide
  Seed: MSTPEATGMTPAEVSIVVLSGTT (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVLSGTT

SEQ ID NO: 332844 - protein, 24 aa, Artificial Sequence
  Description of Artificial Sequence: Synthetic peptide
  Seed: MSTPEATGMTPAEVSIVVLSGTTA (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVLSGTTA

SEQ ID NO: 332845 - protein, 24 aa, Artificial Sequence
  Description of Artificial Sequence: Synthetic peptide
  Seed: MSTPEATGMTPAEVSIVVLSGTTA (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVLSGTTA

SEQ ID NO: 332846 - protein, 24 aa, Artificial Sequence
  Description of Artificial Sequence: Synthetic peptide
  Seed: MSTPEATGMTPAEVSIVVLSGTTA (PMEL_HUMAN)
  Core: EVSIVVLSG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGMTPAXVSXVXLSXTTA

SEQ ID NO: 332847 - protein, 25 aa, Artificial Sequence
  Description of Artificial Sequence: Synthetic peptide
  Seed: MSTPEATGMTPAEVSIVVLSGTTAA (PMEL_HUMAN)
  Core: ATGMTPAEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEXTGXTXAEXSIVVLSGTTAA

SEQ ID NO: 332848 - protein, 25 aa, Artificial Sequence
  Description of Artificial Sequence: Synthetic peptide
  Seed: MSTPEATGMTPAEVSIVVLSGTTAA (PMEL_HUMAN)
  Core: MTPAEVSIV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGXTPXEXSIXVLSGTTAA

SEQ ID NO: 332849 - protein, 25 aa, Artificial Sequence
  Description of Artificial Sequence: Synthetic peptide
  Seed: MSTPEATGMTPAEVSIVVLSGTTAA (PMEL_HUMAN)
  Core: EVSIVVLSG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGMTPAXVSXVXLSXTTAA

SEQ ID NO: 332850 - protein, 25 aa, Artificial Sequence
  Description of Artificial Sequence: Synthetic peptide
  Seed: MSTPEATGMTPAEVSIVVLSGTTAA (PMEL_HUMAN)
  Core: IVVLSGTTA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
MSTPEATGMTPAEVSXVVXSXTTXA

SEQ ID NO: 332851 - protein, 13 aa, Artificial Sequence
  Description of Artificial Sequence: Synthetic peptide
  Seed: MTPAEVSIVVLSG (PMEL_HUMAN)
  Core: AEVSIVVLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MTPXEVXIXVLXG

SEQ ID NO: 332852 - protein, 14 aa, Artificial Sequence
  Description of Artificial Sequence: Synthetic peptide
  Seed: MTPAEVSIVVLSGT (PMEL_HUMAN)
  Core: AEVSIVVLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MTPXEVXIXVLXGT

SEQ ID NO: 332853 - protein, 14 aa, Artificial Sequence
  Description of Artificial Sequence: Synthetic peptide
  Seed: MTPAEVSIVVLSGT (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXT

SEQ ID NO: 332854 - protein, 15 aa, Artificial Sequence
  Description of Artificial Sequence: Synthetic peptide
  Seed: MTPAEVSIVVLSGTT (PMEL_HUMAN)
  Core: AEVSIVVLS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MTPXEVXIXVLXGTT

SEQ ID NO: 332855 - protein, 15 aa, Artificial Sequence
  Description of Artificial Sequence: Synthetic peptide
  Seed: MTPAEVSIVVLSGTT (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTT

SEQ ID NO: 332856 - protein, 16 aa, Artificial Sequence
  Description of Artificial Sequence: Synthetic peptide
  Seed: MTPAEVSIVVLSGTTA (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTTA

SEQ ID NO: 332857 - protein, 16 aa, Artificial Sequence
  Description of Artificial Sequence: Synthetic peptide
  Seed: MTPAEVSIVVLSGTTA (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTX

SEQ ID NO: 332858 - protein, 17 aa, Artificial Sequence
  Description of Artificial Sequence: Synthetic peptide
  Seed: MTPAEVSIVVLSGTTAA (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTTAA

SEQ ID NO: 332859 - protein, 17 aa, Artificial Sequence
  Description of Artificial Sequence: Synthetic peptide
  Seed: MTPAEVSIVVLSGTTAA (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXA

SEQ ID NO: 332860 - protein, 18 aa, Artificial Sequence
  Description of Artificial Sequence: Synthetic peptide
  Seed: MTPAEVSIVVLSGTTAAQ (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTTAAQ

SEQ ID NO: 332861 - protein, 18 aa, Artificial Sequence
  Description of Artificial Sequence: Synthetic peptide
  Seed: MTPAEVSIVVLSGTTAAQ (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQ

SEQ ID NO: 332862 - protein, 18 aa, Artificial Sequence
  Description of Artificial Sequence: Synthetic peptide
  Seed: MTPAEVSIVVLSGTTAAQ (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAX

SEQ ID NO: 332863 - protein, 19 aa, Artificial Sequence
  Description of Artificial Sequence: Synthetic peptide
  Seed: MTPAEVSIVVLSGTTAAQV (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTTAAQV

SEQ ID NO: 332864 - protein, 19 aa, Artificial Sequence
  Description of Artificial Sequence: Synthetic peptide
  Seed: MTPAEVSIVVLSGTTAAQV (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQV

SEQ ID NO: 332865 - protein, 19 aa, Artificial Sequence
  Description of Artificial Sequence: Synthetic peptide
  Seed: MTPAEVSIVVLSGTTAAQV (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXV

SEQ ID NO: 332866 - protein, 19 aa, Artificial Sequence
  Description of Artificial Sequence: Synthetic peptide
  Seed: MTPAEVSIVVLSGTTAAQV (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQX

SEQ ID NO: 332867 - protein, 20 aa, Artificial Sequence
  Description of Artificial Sequence: Synthetic peptide
  Seed: MTPAEVSIVVLSGTTAAQVT (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTTAAQVT

SEQ ID NO: 332868 - protein, 20 aa, Artificial Sequence
  Description of Artificial Sequence: Synthetic peptide
  Seed: MTPAEVSIVVLSGTTAAQVT (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQVT

SEQ ID NO: 332869 - protein, 20 aa, Artificial Sequence
  Description of Artificial Sequence: Synthetic peptide
  Seed: MTPAEVSIVVLSGTTAAQVT (PMEL_HUMAN)
  Core: VVLSGTTAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIXVLXGXTAXQVT

SEQ ID NO: 332870 - protein, 20 aa, Artificial Sequence
  Description of Artificial Sequence: Synthetic peptide
  Seed: MTPAEVSIVVLSGTTAAQVT (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXVT

SEQ ID NO: 332871 - protein, 20 aa, Artificial Sequence
  Description of Artificial Sequence: Synthetic peptide
  Seed: MTPAEVSIVVLSGTTAAQVT (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQXT

SEQ ID NO: 332872 - protein, 21 aa, Artificial Sequence
  Description of Artificial Sequence: Synthetic peptide
  Seed: MTPAEVSIVVLSGTTAAQVTT (PMEL_HUMAN)
  Core: EVSIVVLSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTPAXVSXVXLSXTTAAQVTT

SEQ ID NO: 332873 - protein, 21 aa, Artificial Sequence
  Description of Artificial Sequence: Synthetic peptide
  Seed: MTPAEVSIVVLSGTTAAQVTT (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQVTT

SEQ ID NO: 332874 - protein, 21 aa, Artificial Sequence
  Description of Artificial Sequence: Synthetic peptide
  Seed: MTPAEVSIVVLSGTTAAQVTT (PMEL_HUMAN)
  Core: VVLSGTTAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIXVLXGXTAXQVTT

SEQ ID NO: 332875 - protein, 21 aa, Artificial Sequence
  Description of Artificial Sequence: Synthetic peptide
  Seed: MTPAEVSIVVLSGTTAAQVTT (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXVTT

SEQ ID NO: 332876 - protein, 21 aa, Artificial Sequence
  Description of Artificial Sequence: Synthetic peptide
  Seed: MTPAEVSIVVLSGTTAAQVTT (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQXTT

SEQ ID NO: 332877 - protein, 22 aa, Artificial Sequence
  Description of Artificial Sequence: Synthetic peptide
  Seed: MTPAEVSIVVLSGTTAAQVTTT (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQVTTT

SEQ ID NO: 332878 - protein, 22 aa, Artificial Sequence
  Description of Artificial Sequence: Synthetic peptide
  Seed: MTPAEVSIVVLSGTTAAQVTTT (PMEL_HUMAN)
  Core: VVLSGTTAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIXVLXGXTAXQVTTT

SEQ ID NO: 332879 - protein, 22 aa, Artificial Sequence
  Description of Artificial Sequence: Synthetic peptide
  Seed: MTPAEVSIVVLSGTTAAQVTTT (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXVTTT

SEQ ID NO: 332880 - protein, 22 aa, Artificial Sequence
  Description of Artificial Sequence: Synthetic peptide
  Seed: MTPAEVSIVVLSGTTAAQVTTT (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQXTTT

SEQ ID NO: 332881 - protein, 23 aa, Artificial Sequence
  Description of Artificial Sequence: Synthetic peptide
  Seed: MTPAEVSIVVLSGTTAAQVTTTE (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQVTTTE

SEQ ID NO: 332882 - protein, 23 aa, Artificial Sequence
  Description of Artificial Sequence: Synthetic peptide
  Seed: MTPAEVSIVVLSGTTAAQVTTTE (PMEL_HUMAN)
  Core: VVLSGTTAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIXVLXGXTAXQVTTTE

SEQ ID NO: 332883 - protein, 23 aa, Artificial Sequence
  Description of Artificial Sequence: Synthetic peptide
  Seed: MTPAEVSIVVLSGTTAAQVTTTE (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXVTTTE

SEQ ID NO: 332884 - protein, 23 aa, Artificial Sequence
  Description of Artificial Sequence: Synthetic peptide
  Seed: MTPAEVSIVVLSGTTAAQVTTTE (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQXTTTE

SEQ ID NO: 332885 - protein, 24 aa, Artificial Sequence
  Description of Artificial Sequence: Synthetic peptide
  Seed: MTPAEVSIVVLSGTTAAQVTTTEW (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQVTTTEW

SEQ ID NO: 332886 - protein, 24 aa, Artificial Sequence
  Description of Artificial Sequence: Synthetic peptide
  Seed: MTPAEVSIVVLSGTTAAQVTTTEW (PMEL_HUMAN)
  Core: VVLSGTTAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIXVLXGXTAXQVTTTEW

SEQ ID NO: 332887 - protein, 24 aa, Artificial Sequence
  Description of Artificial Sequence: Synthetic peptide
  Seed: MTPAEVSIVVLSGTTAAQVTTTEW (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXVTTTEW

SEQ ID NO: 332888 - protein, 24 aa, Artificial Sequence
  Description of Artificial Sequence: Synthetic peptide
  Seed: MTPAEVSIVVLSGTTAAQVTTTEW (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQXTTTEW

SEQ ID NO: 332889 - protein, 24 aa, Artificial Sequence
  Description of Artificial Sequence: Synthetic peptide
  Seed: MTPAEVSIVVLSGTTAAQVTTTEW (PMEL_HUMAN)
  Core: TTAAQVTTT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVLSGXTAXQXTTXEW

SEQ ID NO: 332890 - protein, 25 aa, Artificial Sequence
  Description of Artificial Sequence: Synthetic peptide
  Seed: MTPAEVSIVVLSGTTAAQVTTTEWV (PMEL_HUMAN)
  Core: IVVLSGTTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSXVVXSXTTXAQVTTTEWV

SEQ ID NO: 332891 - protein, 25 aa, Artificial Sequence
  Description of Artificial Sequence: Synthetic peptide
  Seed: MTPAEVSIVVLSGTTAAQVTTTEWV (PMEL_HUMAN)
  Core: VVLSGTTAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIXVLXGXTAXQVTTTEWV

SEQ ID NO: 332892 - protein, 25 aa, Artificial Sequence
  Description of Artificial Sequence: Synthetic peptide
  Seed: MTPAEVSIVVLSGTTAAQVTTTEWV (PMEL_HUMAN)
  Core: VLSGTTAAQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVXLSXTXAAXVTTTEWV

SEQ ID NO: 332893 - protein, 25 aa, Artificial Sequence
  Description of Artificial Sequence: Synthetic peptide
  Seed: MTPAEVSIVVLSGTTAAQVTTTEWV (PMEL_HUMAN)
  Core: LSGTTAAQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVXSGXTXAQXTTTEWV

SEQ ID NO: 332894 - protein, 25 aa, Artificial Sequence
  Description of Artificial Sequence: Synthetic peptide
  Seed: MTPAEVSIVVLSGTTAAQVTTTEWV (PMEL_HUMAN)
  Core: TTAAQVTTT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MTPAEVSIVVLSGXTAXQXTTXEWV

SEQ ID NO: 332895 - protein, 19 aa, Artificial Sequence
  Description of Artificial Sequence: Synthetic peptide
  Seed: MTPEKVPVSEVMGTTLAEM (PMEL_HUMAN)
  Core: VPVSEVMGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKXPVXEXMGXTLAEM

SEQ ID NO: 332896 - protein, 19 aa, Artificial Sequence
  Description of Artificial Sequence: Synthetic peptide
  Seed: MTPEKVPVSEVMGTTLAEM (PMEL_HUMAN)
  Core: PVSEVMGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVXVSXVXGTXLAEM

SEQ ID NO: 332897 - protein, 19 aa, Artificial Sequence
  Description of Artificial Sequence: Synthetic peptide
  Seed: MTPEKVPVSEVMGTTLAEM (PMEL_HUMAN)
  Core: VSEVMGTTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPXSEXMXTTXAEM

SEQ ID NO: 332898 - protein, 19 aa, Artificial Sequence
  Description of Artificial Sequence: Synthetic peptide
  Seed: MTPEKVPVSEVMGTTLAEM (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEX

SEQ ID NO: 332899 - protein, 20 aa, Artificial Sequence
  Description of Artificial Sequence: Synthetic peptide
  Seed: MTPEKVPVSEVMGTTLAEMS (PMEL_HUMAN)
  Core: VSEVMGTTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPXSEXMXTTXAEMS

SEQ ID NO: 332900 - protein, 20 aa, Artificial Sequence
  Description of Artificial Sequence: Synthetic peptide
  Seed: MTPEKVPVSEVMGTTLAEMS (PMEL_HUMAN)
  Core: SEVMGTTLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVXEVXGXTLXEMS

SEQ ID NO: 332901 - protein, 20 aa, Artificial Sequence
  Description of Artificial Sequence: Synthetic peptide
  Seed: MTPEKVPVSEVMGTTLAEMS (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEXS

SEQ ID NO: 332902 - protein, 20 aa, Artificial Sequence
  Description of Artificial Sequence: Synthetic peptide
  Seed: MTPEKVPVSEVMGTTLAEMS (PMEL_HUMAN)
  Core: MGTTLAEMS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVXGTXLXEMX

SEQ ID NO: 332903 - protein, 21 aa, Artificial Sequence
  Description of Artificial Sequence: Synthetic peptide
  Seed: MTPEKVPVSEVMGTTLAEMST (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEXST

SEQ ID NO: 332904 - protein, 21 aa, Artificial Sequence
  Description of Artificial Sequence: Synthetic peptide
  Seed: MTPEKVPVSEVMGTTLAEMST (PMEL_HUMAN)
  Core: MGTTLAEMS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVXGTXLXEMXT

SEQ ID NO: 332905 - protein, 22 aa, Artificial Sequence
  Description of Artificial Sequence: Synthetic peptide
  Seed: MTPEKVPVSEVMGTTLAEMSTP (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEXSTP

SEQ ID NO: 332906 - protein, 22 aa, Artificial Sequence
  Description of Artificial Sequence: Synthetic peptide
  Seed: MTPEKVPVSEVMGTTLAEMSTP (PMEL_HUMAN)
  Core: MGTTLAEMS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVXGTXLXEMXTP

SEQ ID NO: 332907 - protein, 23 aa, Artificial Sequence
  Description of Artificial Sequence: Synthetic peptide
  Seed: MTPEKVPVSEVMGTTLAEMSTPE (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEXSTPE

SEQ ID NO: 332908 - protein, 23 aa, Artificial Sequence
  Description of Artificial Sequence: Synthetic peptide
  Seed: MTPEKVPVSEVMGTTLAEMSTPE (PMEL_HUMAN)
  Core: MGTTLAEMS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVXGTXLXEMXTPE

SEQ ID NO: 332909 - protein, 24 aa, Artificial Sequence
  Description of Artificial Sequence: Synthetic peptide
  Seed: MTPEKVPVSEVMGTTLAEMSTPEA (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEXSTPEA

SEQ ID NO: 332910 - protein, 24 aa, Artificial Sequence
  Description of Artificial Sequence: Synthetic peptide
  Seed: MTPEKVPVSEVMGTTLAEMSTPEA (PMEL_HUMAN)
  Core: MGTTLAEMS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVXGTXLXEMXTPEA

SEQ ID NO: 332911 - protein, 25 aa, Artificial Sequence
  Description of Artificial Sequence: Synthetic peptide
  Seed: MTPEKVPVSEVMGTTLAEMSTPEAT (PMEL_HUMAN)
  Core: VMGTTLAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEXMGXTXAEXSTPEAT

SEQ ID NO: 332912 - protein, 25 aa, Artificial Sequence
  Description of Artificial Sequence: Synthetic peptide
  Seed: MTPEKVPVSEVMGTTLAEMSTPEAT (PMEL_HUMAN)
  Core: MGTTLAEMS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVXGTXLXEMXTPEAT

SEQ ID NO: 332913 - protein, 25 aa, Artificial Sequence
  Description of Artificial Sequence: Synthetic peptide
  Seed: MTPEKVPVSEVMGTTLAEMSTPEAT (PMEL_HUMAN)
  Core: LAEMSTPEA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
MTPEKVPVSEVMGTTXAEXSXPEXT

SEQ ID NO: 332914 - protein, 13 aa, Artificial Sequence
  Description of Artificial Sequence: Synthetic peptide
  Seed: NASFSIALNFPGS (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXS

SEQ ID NO: 332915 - protein, 14 aa, Artificial Sequence
  Description of Artificial Sequence: Synthetic peptide
  Seed: NASFSIALNFPGSQ (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQ

SEQ ID NO: 332916 - protein, 15 aa, Artificial Sequence
  Description of Artificial Sequence: Synthetic peptide
  Seed: NASFSIALNFPGSQK (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQK

SEQ ID NO: 332917 - protein, 16 aa, Artificial Sequence
  Description of Artificial Sequence: Synthetic peptide
  Seed: NASFSIALNFPGSQKV (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKV

SEQ ID NO: 332918 - protein, 17 aa, Artificial Sequence
  Description of Artificial Sequence: Synthetic peptide
  Seed: NASFSIALNFPGSQKVL (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVL

SEQ ID NO: 332919 - protein, 18 aa, Artificial Sequence
  Description of Artificial Sequence: Synthetic peptide
  Seed: NASFSIALNFPGSQKVLP (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLP

SEQ ID NO: 332920 - protein, 18 aa, Artificial Sequence
  Description of Artificial Sequence: Synthetic peptide
  Seed: NASFSIALNFPGSQKVLP (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLP

SEQ ID NO: 332921 - protein, 19 aa, Artificial Sequence
  Description of Artificial Sequence: Synthetic peptide
  Seed: NASFSIALNFPGSQKVLPD (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPD

SEQ ID NO: 332922 - protein, 19 aa, Artificial Sequence
  Description of Artificial Sequence: Synthetic peptide
  Seed: NASFSIALNFPGSQKVLPD (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPD

SEQ ID NO: 332923 - protein, 19 aa, Artificial Sequence
  Description of Artificial Sequence: Synthetic peptide
  Seed: NASFSIALNFPGSQKVLPD (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPD

SEQ ID NO: 332924 - protein, 20 aa, Artificial Sequence
  Description of Artificial Sequence: Synthetic peptide
  Seed: NASFSIALNFPGSQKVLPDG (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPDG

SEQ ID NO: 332925 - protein, 20 aa, Artificial Sequence
  Description of Artificial Sequence: Synthetic peptide
  Seed: NASFSIALNFPGSQKVLPDG (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPDG

SEQ ID NO: 332926 - protein, 20 aa, Artificial Sequence
  Description of Artificial Sequence: Synthetic peptide
  Seed: NASFSIALNFPGSQKVLPDG (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPDG

SEQ ID NO: 332927 - protein, 20 aa, Artificial Sequence
  Description of Artificial Sequence: Synthetic peptide
  Seed: NASFSIALNFPGSQKVLPDG (PMEL_HUMAN)
  Core: PGSQKVLPD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIALNFXGSXKXLPXG

SEQ ID NO: 332928 - protein, 21 aa, Artificial Sequence
  Description of Artificial Sequence: Synthetic peptide
  Seed: NASFSIALNFPGSQKVLPDGQ (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPDGQ

SEQ ID NO: 332929 - protein, 21 aa, Artificial Sequence
  Description of Artificial Sequence: Synthetic peptide
  Seed: NASFSIALNFPGSQKVLPDGQ (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPDGQ

SEQ ID NO: 332930 - protein, 21 aa, Artificial Sequence
  Description of Artificial Sequence: Synthetic peptide
  Seed: NASFSIALNFPGSQKVLPDGQ (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPDGQ

SEQ ID NO: 332931 - protein, 22 aa, Artificial Sequence
  Description of Artificial Sequence: Synthetic peptide
  Seed: NASFSIALNFPGSQKVLPDGQV (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPDGQV

SEQ ID NO: 332932 - protein, 22 aa, Artificial Sequence
  Description of Artificial Sequence: Synthetic peptide
  Seed: NASFSIALNFPGSQKVLPDGQV (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPDGQV

SEQ ID NO: 332933 - protein, 22 aa, Artificial Sequence
  Description of Artificial Sequence: Synthetic peptide
  Seed: NASFSIALNFPGSQKVLPDGQV (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPDGQV

SEQ ID NO: 332934 - protein, 23 aa, Artificial Sequence
  Description of Artificial Sequence: Synthetic peptide
  Seed: NASFSIALNFPGSQKVLPDGQVI (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPDGQVI

SEQ ID NO: 332935 - protein, 23 aa, Artificial Sequence
  Description of Artificial Sequence: Synthetic peptide
  Seed: NASFSIALNFPGSQKVLPDGQVI (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPDGQVI

SEQ ID NO: 332936 - protein, 23 aa, Artificial Sequence
  Description of Artificial Sequence: Synthetic peptide
  Seed: NASFSIALNFPGSQKVLPDGQVI (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPDGQVI

SEQ ID NO: 332937 - protein, 24 aa, Artificial Sequence
  Description of Artificial Sequence: Synthetic peptide
  Seed: NASFSIALNFPGSQKVLPDGQVIW (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPDGQVIW

SEQ ID NO: 332938 - protein, 24 aa, Artificial Sequence
  Description of Artificial Sequence: Synthetic peptide
  Seed: NASFSIALNFPGSQKVLPDGQVIW (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPDGQVIW

SEQ ID NO: 332939 - protein, 24 aa, Artificial Sequence
  Description of Artificial Sequence: Synthetic peptide
  Seed: NASFSIALNFPGSQKVLPDGQVIW (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPDGQVIW

SEQ ID NO: 332940 - protein, 25 aa, Artificial Sequence
  Description of Artificial Sequence: Synthetic peptide
  Seed: NASFSIALNFPGSQKVLPDGQVIWV (PMEL_HUMAN)
  Core: FSIALNFPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NASXSIXLXFPXSQKVLPDGQVIWV

SEQ ID NO: 332941 - protein, 25 aa, Artificial Sequence
  Description of Artificial Sequence: Synthetic peptide
  Seed: NASFSIALNFPGSQKVLPDGQVIWV (PMEL_HUMAN)
  Core: IALNFPGSQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NASFSXALXFXGSXKVLPDGQVIWV

SEQ ID NO: 332942 - protein, 25 aa, Artificial Sequence
  Description of Artificial Sequence: Synthetic peptide
  Seed: NASFSIALNFPGSQKVLPDGQVIWV (PMEL_HUMAN)
  Core: LNFPGSQKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIAXNFXGXQKXLPDGQVIWV

SEQ ID NO: 332943 - protein, 25 aa, Artificial Sequence
  Description of Artificial Sequence: Synthetic peptide
  Seed: NASFSIALNFPGSQKVLPDGQVIWV (PMEL_HUMAN)
  Core: QKVLPDGQV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NASFSIALNFPGSXKVXPXGQXIWV

SEQ ID NO: 332944 - protein, 14 aa, Artificial Sequence
  Description of Artificial Sequence: Synthetic peptide
  Seed: NDGPTLIGANASFS (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFS

SEQ ID NO: 332945 - protein, 14 aa, Artificial Sequence
  Description of Artificial Sequence: Synthetic peptide
  Seed: NDGPTLIGANASFS (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFX

SEQ ID NO: 332946 - protein, 15 aa, Artificial Sequence
  Description of Artificial Sequence: Synthetic peptide
  Seed: NDGPTLIGANASFSI (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSI

SEQ ID NO: 332947 - protein, 15 aa, Artificial Sequence
  Description of Artificial Sequence: Synthetic peptide
  Seed: NDGPTLIGANASFSI (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXI

SEQ ID NO: 332948 - protein, 15 aa, Artificial Sequence
  Description of Artificial Sequence: Synthetic peptide
  Seed: NDGPTLIGANASFSI (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSX

SEQ ID NO: 332949 - protein, 16 aa, Artificial Sequence
  Description of Artificial Sequence: Synthetic peptide
  Seed: NDGPTLIGANASFSIA (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIA

SEQ ID NO: 332950 - protein, 16 aa, Artificial Sequence
  Description of Artificial Sequence: Synthetic peptide
  Seed: NDGPTLIGANASFSIA (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIA

SEQ ID NO: 332951 - protein, 16 aa, Artificial Sequence
  Description of Artificial Sequence: Synthetic peptide
  Seed: NDGPTLIGANASFSIA (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXA

SEQ ID NO: 332952 - protein, 17 aa, Artificial Sequence
  Description of Artificial Sequence: Synthetic peptide
  Seed: NDGPTLIGANASFSIAL (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIAL

SEQ ID NO: 332953 - protein, 17 aa, Artificial Sequence
  Description of Artificial Sequence: Synthetic peptide
  Seed: NDGPTLIGANASFSIAL (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIAL

SEQ ID NO: 332954 - protein, 17 aa, Artificial Sequence
  Description of Artificial Sequence: Synthetic peptide
  Seed: NDGPTLIGANASFSIAL (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXAL

SEQ ID NO: 332955 - protein, 18 aa, Artificial Sequence
  Description of Artificial Sequence: Synthetic peptide
  Seed: NDGPTLIGANASFSIALN (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALN

SEQ ID NO: 332956 - protein, 18 aa, Artificial Sequence
  Description of Artificial Sequence: Synthetic peptide
  Seed: NDGPTLIGANASFSIALN (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALN

SEQ ID NO: 332957 - protein, 18 aa, Artificial Sequence
  Description of Artificial Sequence: Synthetic peptide
  Seed: NDGPTLIGANASFSIALN (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALN

SEQ ID NO: 332958 - protein, 19 aa, Artificial Sequence
  Description of Artificial Sequence: Synthetic peptide
  Seed: NDGPTLIGANASFSIALNF (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALNF

SEQ ID NO: 332959 - protein, 19 aa, Artificial Sequence
  Description of Artificial Sequence: Synthetic peptide
  Seed: NDGPTLIGANASFSIALNF (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNF

SEQ ID NO: 332960 - protein, 19 aa, Artificial Sequence
  Description of Artificial Sequence: Synthetic peptide
  Seed: NDGPTLIGANASFSIALNF (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNF

SEQ ID NO: 332961 - protein, 20 aa, Artificial Sequence
  Description of Artificial Sequence: Synthetic peptide
  Seed: NDGPTLIGANASFSIALNFP (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALNFP

SEQ ID NO: 332962 - protein, 20 aa, Artificial Sequence
  Description of Artificial Sequence: Synthetic peptide
  Seed: NDGPTLIGANASFSIALNFP (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNFP

SEQ ID NO: 332963 - protein, 20 aa, Artificial Sequence
  Description of Artificial Sequence: Synthetic peptide
  Seed: NDGPTLIGANASFSIALNFP (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNFP

SEQ ID NO: 332964 - protein, 20 aa, Artificial Sequence
  Description of Artificial Sequence: Synthetic peptide
  Seed: NDGPTLIGANASFSIALNFP (PMEL_HUMAN)
  Core: NASFSIALN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGAXASXSXALXFP

SEQ ID NO: 332965 - protein, 21 aa, Artificial Sequence
  Description of Artificial Sequence: Synthetic peptide
  Seed: NDGPTLIGANASFSIALNFPG (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALNFPG

SEQ ID NO: 332966 - protein, 21 aa, Artificial Sequence
  Description of Artificial Sequence: Synthetic peptide
  Seed: NDGPTLIGANASFSIALNFPG (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNFPG

SEQ ID NO: 332967 - protein, 21 aa, Artificial Sequence
  Description of Artificial Sequence: Synthetic peptide
  Seed: NDGPTLIGANASFSIALNFPG (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNFPG

SEQ ID NO: 332968 - protein, 21 aa, Artificial Sequence
  Description of Artificial Sequence: Synthetic peptide
  Seed: NDGPTLIGANASFSIALNFPG (PMEL_HUMAN)
  Core: NASFSIALN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGAXASXSXALXFPG

SEQ ID NO: 332969 - protein, 21 aa, Artificial Sequence
  Description of Artificial Sequence: Synthetic peptide
  Seed: NDGPTLIGANASFSIALNFPG (PMEL_HUMAN)
  Core: FSIALNFPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANASXSIXLXFPX

SEQ ID NO: 332970 - protein, 22 aa, Artificial Sequence
  Description of Artificial Sequence: Synthetic peptide
  Seed: NDGPTLIGANASFSIALNFPGS (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALNFPGS

SEQ ID NO: 332971 - protein, 22 aa, Artificial Sequence
  Description of Artificial Sequence: Synthetic peptide
  Seed: NDGPTLIGANASFSIALNFPGS (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNFPGS

SEQ ID NO: 332972 - protein, 22 aa, Artificial Sequence
  Description of Artificial Sequence: Synthetic peptide
  Seed: NDGPTLIGANASFSIALNFPGS (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNFPGS

SEQ ID NO: 332973 - protein, 22 aa, Artificial Sequence
  Description of Artificial Sequence: Synthetic peptide
  Seed: NDGPTLIGANASFSIALNFPGS (PMEL_HUMAN)
  Core: NASFSIALN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGAXASXSXALXFPGS

SEQ ID NO: 332974 - protein, 22 aa, Artificial Sequence
  Description of Artificial Sequence: Synthetic peptide
  Seed: NDGPTLIGANASFSIALNFPGS (PMEL_HUMAN)
  Core: ASFSIALNF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANXSFXIXLNXPGS

SEQ ID NO: 332975 - protein, 22 aa, Artificial Sequence
  Description of Artificial Sequence: Synthetic peptide
  Seed: NDGPTLIGANASFSIALNFPGS (PMEL_HUMAN)
  Core: FSIALNFPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANASXSIXLXFPXS

SEQ ID NO: 332976 - protein, 23 aa, Artificial Sequence
  Description of Artificial Sequence: Synthetic peptide
  Seed: NDGPTLIGANASFSIALNFPGSQ (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALNFPGSQ

SEQ ID NO: 332977 - protein, 23 aa, Artificial Sequence
  Description of Artificial Sequence: Synthetic peptide
  Seed: NDGPTLIGANASFSIALNFPGSQ (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNFPGSQ

SEQ ID NO: 332978 - protein, 23 aa, Artificial Sequence
  Description of Artificial Sequence: Synthetic peptide
  Seed: NDGPTLIGANASFSIALNFPGSQ (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNFPGSQ

SEQ ID NO: 332979 - protein, 23 aa, Artificial Sequence
  Description of Artificial Sequence: Synthetic peptide
  Seed: NDGPTLIGANASFSIALNFPGSQ (PMEL_HUMAN)
  Core: NASFSIALN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGAXASXSXALXFPGSQ

SEQ ID NO: 332980 - protein, 23 aa, Artificial Sequence
  Description of Artificial Sequence: Synthetic peptide
  Seed: NDGPTLIGANASFSIALNFPGSQ (PMEL_HUMAN)
  Core: ASFSIALNF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANXSFXIXLNXPGSQ

SEQ ID NO: 332981 - protein, 23 aa, Artificial Sequence
  Description of Artificial Sequence: Synthetic peptide
  Seed: NDGPTLIGANASFSIALNFPGSQ (PMEL_HUMAN)
  Core: FSIALNFPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANASXSIXLXFPXSQ

SEQ ID NO: 332982 - protein, 24 aa, Artificial Sequence
  Description of Artificial Sequence: Synthetic peptide
  Seed: NDGPTLIGANASFSIALNFPGSQK (PMEL_HUMAN)
  Core: PTLIGANAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NDGXTLXGXNAXFSIALNFPGSQK

SEQ ID NO: 332983 - protein, 24 aa, Artificial Sequence
  Description of Artificial Sequence: Synthetic peptide
  Seed: NDGPTLIGANASFSIALNFPGSQK (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNFPGSQK

SEQ ID NO: 332984 - protein, 24 aa, Artificial Sequence
  Description of Artificial Sequence: Synthetic peptide
  Seed: NDGPTLIGANASFSIALNFPGSQK (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNFPGSQK

SEQ ID NO: 332985 - protein, 24 aa, Artificial Sequence
  Description of Artificial Sequence: Synthetic peptide
  Seed: NDGPTLIGANASFSIALNFPGSQK (PMEL_HUMAN)
  Core: NASFSIALN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGAXASXSXALXFPGSQK

SEQ ID NO: 332986 - protein, 24 aa, Artificial Sequence
  Description of Artificial Sequence: Synthetic peptide
  Seed: NDGPTLIGANASFSIALNFPGSQK (PMEL_HUMAN)
  Core: FSIALNFPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANASXSIXLXFPXSQK

SEQ ID NO: 332987 - protein, 25 aa, Artificial Sequence
  Description of Artificial Sequence: Synthetic peptide
  Seed: NDGPTLIGANASFSIALNFPGSQKV (PMEL_HUMAN)
  Core: LIGANASFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTXIGXNXSFXIALNFPGSQKV

SEQ ID NO: 332988 - protein, 25 aa, Artificial Sequence
  Description of Artificial Sequence: Synthetic peptide
  Seed: NDGPTLIGANASFSIALNFPGSQKV (PMEL_HUMAN)
  Core: IGANASFSI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLXGAXAXFSXALNFPGSQKV

SEQ ID NO: 332989 - protein, 25 aa, Artificial Sequence
  Description of Artificial Sequence: Synthetic peptide
  Seed: NDGPTLIGANASFSIALNFPGSQKV (PMEL_HUMAN)
  Core: NASFSIALN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGAXASXSXALXFPGSQKV

SEQ ID NO: 332990 - protein, 25 aa, Artificial Sequence
  Description of Artificial Sequence: Synthetic peptide
  Seed: NDGPTLIGANASFSIALNFPGSQKV (PMEL_HUMAN)
  Core: FSIALNFPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NDGPTLIGANASXSIXLXFPXSQKV

SEQ ID NO: 332991 - protein, 20 aa, Artificial Sequence
  Description of Artificial Sequence: Synthetic peptide
  Seed: NFPGSQKVLPDGQVIWVNNT (PMEL_HUMAN)
  Core: QKVLPDGQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSXKVXPXGQXIWVNNT

SEQ ID NO: 332992 - protein, 21 aa, Artificial Sequence
  Description of Artificial Sequence: Synthetic peptide
  Seed: NFPGSQKVLPDGQVIWVNNTI (PMEL_HUMAN)
  Core: QKVLPDGQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSXKVXPXGQXIWVNNTI

SEQ ID NO: 332993 - protein, 22 aa, Artificial Sequence
  Description of Artificial Sequence: Synthetic peptide
  Seed: NFPGSQKVLPDGQVIWVNNTII (PMEL_HUMAN)
  Core: VLPDGQVIW
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKXLPXGXVIXVNNTII

SEQ ID NO: 332994 - protein, 22 aa, Artificial Sequence
  Description of Artificial Sequence: Synthetic peptide
  Seed: NFPGSQKVLPDGQVIWVNNTII (PMEL_HUMAN)
  Core: QVIWVNNTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGXVIXVXNTXI

SEQ ID NO: 332995 - protein, 23 aa, Artificial Sequence
  Description of Artificial Sequence: Synthetic peptide
  Seed: NFPGSQKVLPDGQVIWVNNTIIN (PMEL_HUMAN)
  Core: QVIWVNNTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGXVIXVXNTXIN

SEQ ID NO: 332996 - protein, 23 aa, Artificial Sequence
  Description of Artificial Sequence: Synthetic peptide
  Seed: NFPGSQKVLPDGQVIWVNNTIIN (PMEL_HUMAN)
  Core: VIWVNNTII
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGQXIWXNXTIXN

SEQ ID NO: 332997 - protein, 23 aa, Artificial Sequence
  Description of Artificial Sequence: Synthetic peptide
  Seed: NFPGSQKVLPDGQVIWVNNTIIN (PMEL_HUMAN)
  Core: IWVNNTIIN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGQVXWVXNXIIX

SEQ ID NO: 332998 - protein, 24 aa, Artificial Sequence
  Description of Artificial Sequence: Synthetic peptide
  Seed: NFPGSQKVLPDGQVIWVNNTIING (PMEL_HUMAN)
  Core: QVIWVNNTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGXVIXVXNTXING

SEQ ID NO: 332999 - protein, 24 aa, Artificial Sequence
  Description of Artificial Sequence: Synthetic peptide
  Seed: NFPGSQKVLPDGQVIWVNNTIING (PMEL_HUMAN)
  Core: VIWVNNTII
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGQXIWXNXTIXNG

SEQ ID NO: 333000 - protein, 24 aa, Artificial Sequence
  Description of Artificial Sequence: Synthetic peptide
  Seed: NFPGSQKVLPDGQVIWVNNTIING (PMEL_HUMAN)
  Core: IWVNNTIIN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGQVXWVXNXIIXG

SEQ ID NO: 333001 - protein, 25 aa, Artificial Sequence
  Description of Artificial Sequence: Synthetic peptide
  Seed: NFPGSQKVLPDGQVIWVNNTIINGS (PMEL_HUMAN)
  Core: QVIWVNNTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGXVIXVXNTXINGS

SEQ ID NO: 333002 - protein, 25 aa, Artificial Sequence
  Description of Artificial Sequence: Synthetic peptide
  Seed: NFPGSQKVLPDGQVIWVNNTIINGS (PMEL_HUMAN)
  Core: VIWVNNTII
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGQXIWXNXTIXNGS

SEQ ID NO: 333003 - protein, 25 aa, Artificial Sequence
  Description of Artificial Sequence: Synthetic peptide
  Seed: NFPGSQKVLPDGQVIWVNNTIINGS (PMEL_HUMAN)
  Core: IWVNNTIIN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
NFPGSQKVLPDGQVXWVXNXIIXGS

SEQ ID NO: 333004 - protein, 13 aa, Artificial Sequence
  Description of Artificial Sequence: Synthetic peptide
  Seed: NGSQVWGGQPVYP (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYX

SEQ ID NO: 333005 - protein, 14 aa, Artificial Sequence
  Description of Artificial Sequence: Synthetic peptide
  Seed: NGSQVWGGQPVYPQ (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQ

SEQ ID NO: 333006 - protein, 15 aa, Artificial Sequence
  Description of Artificial Sequence: Synthetic peptide
  Seed: NGSQVWGGQPVYPQE (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQE

SEQ ID NO: 333007 - protein, 16 aa, Artificial Sequence
  Description of Artificial Sequence: Synthetic peptide
  Seed: NGSQVWGGQPVYPQET (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQET

SEQ ID NO: 333008 - protein, 17 aa, Artificial Sequence
  Description of Artificial Sequence: Synthetic peptide
  Seed: NGSQVWGGQPVYPQETD (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETD

SEQ ID NO: 333009 - protein, 18 aa, Artificial Sequence
  Description of Artificial Sequence: Synthetic peptide
  Seed: NGSQVWGGQPVYPQETDD (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDD

SEQ ID NO: 333010 - protein, 19 aa, Artificial Sequence
  Description of Artificial Sequence: Synthetic peptide
  Seed: NGSQVWGGQPVYPQETDDA (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDA

SEQ ID NO: 333011 - protein, 20 aa, Artificial Sequence
  Description of Artificial Sequence: Synthetic peptide
  Seed: NGSQVWGGQPVYPQETDDAC (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDAC

SEQ ID NO: 333012 - protein, 21 aa, Artificial Sequence
  Description of Artificial Sequence: Synthetic peptide
  Seed: NGSQVWGGQPVYPQETDDACI (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDACI

SEQ ID NO: 333013 - protein, 22 aa, Artificial Sequence
  Description of Artificial Sequence: Synthetic peptide
  Seed: NGSQVWGGQPVYPQETDDACIF (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDACIF

SEQ ID NO: 333014 - protein, 23 aa, Artificial Sequence
  Description of Artificial Sequence: Synthetic peptide
  Seed: NGSQVWGGQPVYPQETDDACIFP (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDACIFP

SEQ ID NO: 333015 - protein, 24 aa, Artificial Sequence
  Description of Artificial Sequence: Synthetic peptide
  Seed: NGSQVWGGQPVYPQETDDACIFPD (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDACIFPD

SEQ ID NO: 333016 - protein, 25 aa, Artificial Sequence
  Description of Artificial Sequence: Synthetic peptide
  Seed: NGSQVWGGQPVYPQETDDACIFPDG (PMEL_HUMAN)
  Core: VWGGQPVYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NGSQXWGXQXVYXQETDDACIFPDG

SEQ ID NO: 333017 - protein, 13 aa, Artificial Sequence
  Description of Artificial Sequence: Synthetic peptide
  Seed: NKHFLRNQPLTFA (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXA

SEQ ID NO: 333018 - protein, 14 aa, Artificial Sequence
  Description of Artificial Sequence: Synthetic peptide
  Seed: NKHFLRNQPLTFAL (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXAL

SEQ ID NO: 333019 - protein, 14 aa, Artificial Sequence
  Description of Artificial Sequence: Synthetic peptide
  Seed: NKHFLRNQPLTFAL (PMEL_HUMAN)
  Core: LRNQPLTFA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NKHFXRNXPXTFXL

SEQ ID NO: 333020 - protein, 16 aa, Artificial Sequence
  Description of Artificial Sequence: Synthetic peptide
  Seed: NKHFLRNQPLTFALQL (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQL

SEQ ID NO: 333021 - protein, 16 aa, Artificial Sequence
  Description of Artificial Sequence: Synthetic peptide
  Seed: NKHFLRNQPLTFALQL (PMEL_HUMAN)
  Core: LRNQPLTFA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NKHFXRNXPXTFXLQL

SEQ ID NO: 333022 - protein, 16 aa, Artificial Sequence
  Description of Artificial Sequence: Synthetic peptide
  Seed: NKHFLRNQPLTFALQL (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQL

SEQ ID NO: 333023 - protein, 17 aa, Artificial Sequence
  Description of Artificial Sequence: Synthetic peptide
  Seed: NKHFLRNQPLTFALQLH (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLH

SEQ ID NO: 333024 - protein, 17 aa, Artificial Sequence
  Description of Artificial Sequence: Synthetic peptide
  Seed: NKHFLRNQPLTFALQLH (PMEL_HUMAN)
  Core: LRNQPLTFA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NKHFXRNXPXTFXLQLH

SEQ ID NO: 333025 - protein, 17 aa, Artificial Sequence
  Description of Artificial Sequence: Synthetic peptide
  Seed: NKHFLRNQPLTFALQLH (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLH

SEQ ID NO: 333026 - protein, 18 aa, Artificial Sequence
  Description of Artificial Sequence: Synthetic peptide
  Seed: NKHFLRNQPLTFALQLHD (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHD

SEQ ID NO: 333027 - protein, 18 aa, Artificial Sequence
  Description of Artificial Sequence: Synthetic peptide
  Seed: NKHFLRNQPLTFALQLHD (PMEL_HUMAN)
  Core: LRNQPLTFA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NKHFXRNXPXTFXLQLHD

SEQ ID NO: 333028 - protein, 18 aa, Artificial Sequence
  Description of Artificial Sequence: Synthetic peptide
  Seed: NKHFLRNQPLTFALQLHD (PMEL_HUMAN)
  Core: NQPLTFALQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRXQPXTXALXLHD

SEQ ID NO: 333029 - protein, 18 aa, Artificial Sequence
  Description of Artificial Sequence: Synthetic peptide
  Seed: NKHFLRNQPLTFALQLHD (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXD

SEQ ID NO: 333030 - protein, 19 aa, Artificial Sequence
  Description of Artificial Sequence: Synthetic peptide
  Seed: NKHFLRNQPLTFALQLHDP (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDP

SEQ ID NO: 333031 - protein, 19 aa, Artificial Sequence
  Description of Artificial Sequence: Synthetic peptide
  Seed: NKHFLRNQPLTFALQLHDP (PMEL_HUMAN)
  Core: LRNQPLTFA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NKHFXRNXPXTFXLQLHDP

SEQ ID NO: 333032 - protein, 19 aa, Artificial Sequence
  Description of Artificial Sequence: Synthetic peptide
  Seed: NKHFLRNQPLTFALQLHDP (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDP

SEQ ID NO: 333033 - protein, 19 aa, Artificial Sequence
  Description of Artificial Sequence: Synthetic peptide
  Seed: NKHFLRNQPLTFALQLHDP (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDP

SEQ ID NO: 333034 - protein, 19 aa, Artificial Sequence
  Description of Artificial Sequence: Synthetic peptide
  Seed: NKHFLRNQPLTFALQLHDP (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXP

SEQ ID NO: 333035 - protein, 20 aa, Artificial Sequence
  Description of Artificial Sequence: Synthetic peptide
  Seed: NKHFLRNQPLTFALQLHDPS (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDPS

SEQ ID NO: 333036 - protein, 20 aa, Artificial Sequence
  Description of Artificial Sequence: Synthetic peptide
  Seed: NKHFLRNQPLTFALQLHDPS (PMEL_HUMAN)
  Core: LRNQPLTFA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NKHFXRNXPXTFXLQLHDPS

SEQ ID NO: 333037 - protein, 20 aa, Artificial Sequence
  Description of Artificial Sequence: Synthetic peptide
  Seed: NKHFLRNQPLTFALQLHDPS (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDPS

SEQ ID NO: 333038 - protein, 20 aa, Artificial Sequence
  Description of Artificial Sequence: Synthetic peptide
  Seed: NKHFLRNQPLTFALQLHDPS (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDPS

SEQ ID NO: 333039 - protein, 20 aa, Artificial Sequence
  Description of Artificial Sequence: Synthetic peptide
  Seed: NKHFLRNQPLTFALQLHDPS (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXPS

SEQ ID NO: 333040 - protein, 21 aa, Artificial Sequence
  Description of Artificial Sequence: Synthetic peptide
  Seed: NKHFLRNQPLTFALQLHDPSG (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDPSG

SEQ ID NO: 333041 - protein, 21 aa, Artificial Sequence
  Description of Artificial Sequence: Synthetic peptide
  Seed: NKHFLRNQPLTFALQLHDPSG (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDPSG

SEQ ID NO: 333042 - protein, 21 aa, Artificial Sequence
  Description of Artificial Sequence: Synthetic peptide
  Seed: NKHFLRNQPLTFALQLHDPSG (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDPSG

SEQ ID NO: 333043 - protein, 21 aa, Artificial Sequence
  Description of Artificial Sequence: Synthetic peptide
  Seed: NKHFLRNQPLTFALQLHDPSG (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXPSG

SEQ ID NO: 333044 - protein, 21 aa, Artificial Sequence
  Description of Artificial Sequence: Synthetic peptide
  Seed: NKHFLRNQPLTFALQLHDPSG (PMEL_HUMAN)
  Core: FALQLHDPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPLTXALXLXDPXG

SEQ ID NO: 333045 - protein, 22 aa, Artificial Sequence
  Description of Artificial Sequence: Synthetic peptide
  Seed: NKHFLRNQPLTFALQLHDPSGY (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDPSGY

SEQ ID NO: 333046 - protein, 22 aa, Artificial Sequence
  Description of Artificial Sequence: Synthetic peptide
  Seed: NKHFLRNQPLTFALQLHDPSGY (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDPSGY

SEQ ID NO: 333047 - protein, 22 aa, Artificial Sequence
  Description of Artificial Sequence: Synthetic peptide
  Seed: NKHFLRNQPLTFALQLHDPSGY (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDPSGY

SEQ ID NO: 333048 - protein, 22 aa, Artificial Sequence
  Description of Artificial Sequence: Synthetic peptide
  Seed: NKHFLRNQPLTFALQLHDPSGY (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXPSGY

SEQ ID NO: 333049 - protein, 22 aa, Artificial Sequence
  Description of Artificial Sequence: Synthetic peptide
  Seed: NKHFLRNQPLTFALQLHDPSGY (PMEL_HUMAN)
  Core: FALQLHDPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPLTXALXLXDPXGY

SEQ ID NO: 333050 - protein, 23 aa, Artificial Sequence
  Description of Artificial Sequence: Synthetic peptide
  Seed: NKHFLRNQPLTFALQLHDPSGYL (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDPSGYL

SEQ ID NO: 333051 - protein, 23 aa, Artificial Sequence
  Description of Artificial Sequence: Synthetic peptide
  Seed: NKHFLRNQPLTFALQLHDPSGYL (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDPSGYL

SEQ ID NO: 333052 - protein, 23 aa, Artificial Sequence
  Description of Artificial Sequence: Synthetic peptide
  Seed: NKHFLRNQPLTFALQLHDPSGYL (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDPSGYL

SEQ ID NO: 333053 - protein, 23 aa, Artificial Sequence
  Description of Artificial Sequence: Synthetic peptide
  Seed: NKHFLRNQPLTFALQLHDPSGYL (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXPSGYL

SEQ ID NO: 333054 - protein, 23 aa, Artificial Sequence
  Description of Artificial Sequence: Synthetic peptide
  Seed: NKHFLRNQPLTFALQLHDPSGYL (PMEL_HUMAN)
  Core: FALQLHDPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPLTXALXLXDPXGYL

SEQ ID NO: 333055 - protein, 24 aa, Artificial Sequence
  Description of Artificial Sequence: Synthetic peptide
  Seed: NKHFLRNQPLTFALQLHDPSGYLA (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDPSGYLA

SEQ ID NO: 333056 - protein, 24 aa, Artificial Sequence
  Description of Artificial Sequence: Synthetic peptide
  Seed: NKHFLRNQPLTFALQLHDPSGYLA (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDPSGYLA

SEQ ID NO: 333057 - protein, 24 aa, Artificial Sequence
  Description of Artificial Sequence: Synthetic peptide
  Seed: NKHFLRNQPLTFALQLHDPSGYLA (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDPSGYLA

SEQ ID NO: 333058 - protein, 24 aa, Artificial Sequence
  Description of Artificial Sequence: Synthetic peptide
  Seed: NKHFLRNQPLTFALQLHDPSGYLA (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXPSGYLA

SEQ ID NO: 333059 - protein, 24 aa, Artificial Sequence
  Description of Artificial Sequence: Synthetic peptide
  Seed: NKHFLRNQPLTFALQLHDPSGYLA (PMEL_HUMAN)
  Core: FALQLHDPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPLTXALXLXDPXGYLA

SEQ ID NO: 333060 - protein, 25 aa, Artificial Sequence
  Description of Artificial Sequence: Synthetic peptide
  Seed: NKHFLRNQPLTFALQLHDPSGYLAE (PMEL_HUMAN)
  Core: FLRNQPLTF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NKHXLRXQXLTXALQLHDPSGYLAE

SEQ ID NO: 333061 - protein, 25 aa, Artificial Sequence
  Description of Artificial Sequence: Synthetic peptide
  Seed: NKHFLRNQPLTFALQLHDPSGYLAE (PMEL_HUMAN)
  Core: RNQPLTFAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLXNQXLXFAXQLHDPSGYLAE

SEQ ID NO: 333062 - protein, 25 aa, Artificial Sequence
  Description of Artificial Sequence: Synthetic peptide
  Seed: NKHFLRNQPLTFALQLHDPSGYLAE (PMEL_HUMAN)
  Core: PLTFALQLH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQXLTXAXQLXDPSGYLAE

SEQ ID NO: 333063 - protein, 25 aa, Artificial Sequence
  Description of Artificial Sequence: Synthetic peptide
  Seed: NKHFLRNQPLTFALQLHDPSGYLAE (PMEL_HUMAN)
  Core: LTFALQLHD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPXTFXLXLHXPSGYLAE

SEQ ID NO: 333064 - protein, 25 aa, Artificial Sequence
  Description of Artificial Sequence: Synthetic peptide
  Seed: NKHFLRNQPLTFALQLHDPSGYLAE (PMEL_HUMAN)
  Core: FALQLHDPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPLTXALXLXDPXGYLAE

SEQ ID NO: 333065 - protein, 25 aa, Artificial Sequence
  Description of Artificial Sequence: Synthetic peptide
  Seed: NKHFLRNQPLTFALQLHDPSGYLAE (PMEL_HUMAN)
  Core: LQLHDPSGY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
NKHFLRNQPLTFAXQLXDXSGXLAE

SEQ ID NO: 333066 - protein, 13 aa, Artificial Sequence
  Description of Artificial Sequence: Synthetic peptide
  Seed: NNTIINGSQVWGG (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGX

SEQ ID NO: 333067 - protein, 14 aa, Artificial Sequence
  Description of Artificial Sequence: Synthetic peptide
  Seed: NNTIINGSQVWGGQ (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQ

SEQ ID NO: 333068 - protein, 15 aa, Artificial Sequence
  Description of Artificial Sequence: Synthetic peptide
  Seed: NNTIINGSQVWGGQP (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQP

SEQ ID NO: 333069 - protein, 16 aa, Artificial Sequence
  Description of Artificial Sequence: Synthetic peptide
  Seed: NNTIINGSQVWGGQPV (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPV

SEQ ID NO: 333070 - protein, 17 aa, Artificial Sequence
  Description of Artificial Sequence: Synthetic peptide
  Seed: NNTIINGSQVWGGQPVY (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVY

SEQ ID NO: 333071 - protein, 18 aa, Artificial Sequence
  Description of Artificial Sequence: Synthetic peptide
  Seed: NNTIINGSQVWGGQPVYP (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYP

SEQ ID NO: 333072 - protein, 19 aa, Artificial Sequence
  Description of Artificial Sequence: Synthetic peptide
  Seed: NNTIINGSQVWGGQPVYPQ (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQ

SEQ ID NO: 333073 - protein, 20 aa, Artificial Sequence
  Description of Artificial Sequence: Synthetic peptide
  Seed: NNTIINGSQVWGGQPVYPQE (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQE

SEQ ID NO: 333074 - protein, 20 aa, Artificial Sequence
  Description of Artificial Sequence: Synthetic peptide
  Seed: NNTIINGSQVWGGQPVYPQE (PMEL_HUMAN)
  Core: VWGGQPVYP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQXWGXQXVYXQE

SEQ ID NO: 333075 - protein, 21 aa, Artificial Sequence
  Description of Artificial Sequence: Synthetic peptide
  Seed: NNTIINGSQVWGGQPVYPQET (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQET

SEQ ID NO: 333076 - protein, 21 aa, Artificial Sequence
  Description of Artificial Sequence: Synthetic peptide
  Seed: NNTIINGSQVWGGQPVYPQET (PMEL_HUMAN)
  Core: VWGGQPVYP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQXWGXQXVYXQET

SEQ ID NO: 333077 - protein, 22 aa, Artificial Sequence
  Description of Artificial Sequence: Synthetic peptide
  Seed: NNTIINGSQVWGGQPVYPQETD (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQETD

SEQ ID NO: 333078 - protein, 22 aa, Artificial Sequence
  Description of Artificial Sequence: Synthetic peptide
  Seed: NNTIINGSQVWGGQPVYPQETD (PMEL_HUMAN)
  Core: VWGGQPVYP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQXWGXQXVYXQETD

SEQ ID NO: 333079 - protein, 22 aa, Artificial Sequence
  Description of Artificial Sequence: Synthetic peptide
  Seed: NNTIINGSQVWGGQPVYPQETD (PMEL_HUMAN)
  Core: WGGQPVYPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQVXGGXPXYPXETD

SEQ ID NO: 333080 - protein, 23 aa, Artificial Sequence
  Description of Artificial Sequence: Synthetic peptide
  Seed: NNTIINGSQVWGGQPVYPQETDD (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQETDD

SEQ ID NO: 333081 - protein, 23 aa, Artificial Sequence
  Description of Artificial Sequence: Synthetic peptide
  Seed: NNTIINGSQVWGGQPVYPQETDD (PMEL_HUMAN)
  Core: VWGGQPVYP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQXWGXQXVYXQETDD

SEQ ID NO: 333082 - protein, 23 aa, Artificial Sequence
  Description of Artificial Sequence: Synthetic peptide
  Seed: NNTIINGSQVWGGQPVYPQETDD (PMEL_HUMAN)
  Core: WGGQPVYPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQVXGGXPXYPXETDD

SEQ ID NO: 333083 - protein, 24 aa, Artificial Sequence
  Description of Artificial Sequence: Synthetic peptide
  Seed: NNTIINGSQVWGGQPVYPQETDDA (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQETDDA

SEQ ID NO: 333084 - protein, 24 aa, Artificial Sequence
  Description of Artificial Sequence: Synthetic peptide
  Seed: NNTIINGSQVWGGQPVYPQETDDA (PMEL_HUMAN)
  Core: VWGGQPVYP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQXWGXQXVYXQETDDA

SEQ ID NO: 333085 - protein, 24 aa, Artificial Sequence
  Description of Artificial Sequence: Synthetic peptide
  Seed: NNTIINGSQVWGGQPVYPQETDDA (PMEL_HUMAN)
  Core: WGGQPVYPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQVXGGXPXYPXETDDA

SEQ ID NO: 333086 - protein, 25 aa, Artificial Sequence
  Description of Artificial Sequence: Synthetic peptide
  Seed: NNTIINGSQVWGGQPVYPQETDDAC (PMEL_HUMAN)
  Core: INGSQVWGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NNTIXNGXQXWGXQPVYPQETDDAC

SEQ ID NO: 333087 - protein, 25 aa, Artificial Sequence
  Description of Artificial Sequence: Synthetic peptide
  Seed: NNTIINGSQVWGGQPVYPQETDDAC (PMEL_HUMAN)
  Core: VWGGQPVYP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQXWGXQXVYXQETDDAC

SEQ ID NO: 333088 - protein, 25 aa, Artificial Sequence
  Description of Artificial Sequence: Synthetic peptide
  Seed: NNTIINGSQVWGGQPVYPQETDDAC (PMEL_HUMAN)
  Core: WGGQPVYPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NNTIINGSQVXGGXPXYPXETDDAC

SEQ ID NO: 333089 - protein, 14 aa, Artificial Sequence
  Description of Artificial Sequence: Synthetic peptide
  Seed: NQDWLGVSRQLRTK (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTK

SEQ ID NO: 333090 - protein, 15 aa, Artificial Sequence
  Description of Artificial Sequence: Synthetic peptide
  Seed: NQDWLGVSRQLRTKA (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKA

SEQ ID NO: 333091 - protein, 15 aa, Artificial Sequence
  Description of Artificial Sequence: Synthetic peptide
  Seed: NQDWLGVSRQLRTKA (PMEL_HUMAN)
  Core: LGVSRQLRT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NQDWXGVXRXLRXKA

SEQ ID NO: 333092 - protein, 16 aa, Artificial Sequence
  Description of Artificial Sequence: Synthetic peptide
  Seed: NQDWLGVSRQLRTKAW (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAW

SEQ ID NO: 333093 - protein, 16 aa, Artificial Sequence
  Description of Artificial Sequence: Synthetic peptide
  Seed: NQDWLGVSRQLRTKAW (PMEL_HUMAN)
  Core: LGVSRQLRT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NQDWXGVXRXLRXKAW

SEQ ID NO: 333094 - protein, 17 aa, Artificial Sequence
  Description of Artificial Sequence: Synthetic peptide
  Seed: NQDWLGVSRQLRTKAWN (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWN

SEQ ID NO: 333095 - protein, 17 aa, Artificial Sequence
  Description of Artificial Sequence: Synthetic peptide
  Seed: NQDWLGVSRQLRTKAWN (PMEL_HUMAN)
  Core: LGVSRQLRT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NQDWXGVXRXLRXKAWN

SEQ ID NO: 333096 - protein, 18 aa, Artificial Sequence
  Description of Artificial Sequence: Synthetic peptide
  Seed: NQDWLGVSRQLRTKAWNR (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNR

SEQ ID NO: 333097 - protein, 19 aa, Artificial Sequence
  Description of Artificial Sequence: Synthetic peptide
  Seed: NQDWLGVSRQLRTKAWNRQ (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQ

SEQ ID NO: 333098 - protein, 19 aa, Artificial Sequence
  Description of Artificial Sequence: Synthetic peptide
  Seed: NQDWLGVSRQLRTKAWNRQ (PMEL_HUMAN)
  Core: LGVSRQLRT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NQDWXGVXRXLRXKAWNRQ

SEQ ID NO: 333099 - protein, 19 aa, Artificial Sequence
  Description of Artificial Sequence: Synthetic peptide
  Seed: NQDWLGVSRQLRTKAWNRQ (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRX

SEQ ID NO: 333100 - protein, 20 aa, Artificial Sequence
  Description of Artificial Sequence: Synthetic peptide
  Seed: NQDWLGVSRQLRTKAWNRQL (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQL

SEQ ID NO: 333101 - protein, 20 aa, Artificial Sequence
  Description of Artificial Sequence: Synthetic peptide
  Seed: NQDWLGVSRQLRTKAWNRQL (PMEL_HUMAN)
  Core: QLRTKAWNR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRXLRXKXWNXQL

SEQ ID NO: 333102 - protein, 20 aa, Artificial Sequence
  Description of Artificial Sequence: Synthetic peptide
  Seed: NQDWLGVSRQLRTKAWNRQL (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRXL

SEQ ID NO: 333103 - protein, 21 aa, Artificial Sequence
  Description of Artificial Sequence: Synthetic peptide
  Seed: NQDWLGVSRQLRTKAWNRQLY (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQLY

SEQ ID NO: 333104 - protein, 21 aa, Artificial Sequence
  Description of Artificial Sequence: Synthetic peptide
  Seed: NQDWLGVSRQLRTKAWNRQLY (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRXLY

SEQ ID NO: 333105 - protein, 22 aa, Artificial Sequence
  Description of Artificial Sequence: Synthetic peptide
  Seed: NQDWLGVSRQLRTKAWNRQLYP (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQLYP

SEQ ID NO: 333106 - protein, 22 aa, Artificial Sequence
  Description of Artificial Sequence: Synthetic peptide
  Seed: NQDWLGVSRQLRTKAWNRQLYP (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRXLYP

SEQ ID NO: 333107 - protein, 23 aa, Artificial Sequence
  Description of Artificial Sequence: Synthetic peptide
  Seed: NQDWLGVSRQLRTKAWNRQLYPE (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQLYPE

SEQ ID NO: 333108 - protein, 23 aa, Artificial Sequence
  Description of Artificial Sequence: Synthetic peptide
  Seed: NQDWLGVSRQLRTKAWNRQLYPE (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRXLYPE

SEQ ID NO: 333109 - protein, 23 aa, Artificial Sequence
  Description of Artificial Sequence: Synthetic peptide
  Seed: NQDWLGVSRQLRTKAWNRQLYPE (PMEL_HUMAN)
  Core: TKAWNRQLY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQLRXKAXNXQLXPE

SEQ ID NO: 333110 - protein, 24 aa, Artificial Sequence
  Description of Artificial Sequence: Synthetic peptide
  Seed: NQDWLGVSRQLRTKAWNRQLYPEW (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQLYPEW

SEQ ID NO: 333111 - protein, 24 aa, Artificial Sequence
  Description of Artificial Sequence: Synthetic peptide
  Seed: NQDWLGVSRQLRTKAWNRQLYPEW (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRXLYPEW

SEQ ID NO: 333112 - protein, 24 aa, Artificial Sequence
  Description of Artificial Sequence: Synthetic peptide
  Seed: NQDWLGVSRQLRTKAWNRQLYPEW (PMEL_HUMAN)
  Core: TKAWNRQLY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQLRXKAXNXQLXPEW

SEQ ID NO: 333113 - protein, 25 aa, Artificial Sequence
  Description of Artificial Sequence: Synthetic peptide
  Seed: NQDWLGVSRQLRTKAWNRQLYPEWT (PMEL_HUMAN)
  Core: WLGVSRQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQDXLGXSXQLXTKAWNRQLYPEWT

SEQ ID NO: 333114 - protein, 25 aa, Artificial Sequence
  Description of Artificial Sequence: Synthetic peptide
  Seed: NQDWLGVSRQLRTKAWNRQLYPEWT (PMEL_HUMAN)
  Core: LRTKAWNRQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQXRTXAXNRXLYPEWT

SEQ ID NO: 333115 - protein, 25 aa, Artificial Sequence
  Description of Artificial Sequence: Synthetic peptide
  Seed: NQDWLGVSRQLRTKAWNRQLYPEWT (PMEL_HUMAN)
  Core: TKAWNRQLY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQDWLGVSRQLRXKAXNXQLXPEWT

SEQ ID NO: 333116 - protein, 14 aa, Artificial Sequence
  Description of Artificial Sequence: Synthetic peptide
  Seed: NQPLTFALQLHDPS (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPS

SEQ ID NO: 333117 - protein, 15 aa, Artificial Sequence
  Description of Artificial Sequence: Synthetic peptide
  Seed: NQPLTFALQLHDPSG (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSG

SEQ ID NO: 333118 - protein, 15 aa, Artificial Sequence
  Description of Artificial Sequence: Synthetic peptide
  Seed: NQPLTFALQLHDPSG (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXG

SEQ ID NO: 333119 - protein, 16 aa, Artificial Sequence
  Description of Artificial Sequence: Synthetic peptide
  Seed: NQPLTFALQLHDPSGY (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGY

SEQ ID NO: 333120 - protein, 16 aa, Artificial Sequence
  Description of Artificial Sequence: Synthetic peptide
  Seed: NQPLTFALQLHDPSGY (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGY

SEQ ID NO: 333121 - protein, 17 aa, Artificial Sequence
  Description of Artificial Sequence: Synthetic peptide
  Seed: NQPLTFALQLHDPSGYL (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYL

SEQ ID NO: 333122 - protein, 17 aa, Artificial Sequence
  Description of Artificial Sequence: Synthetic peptide
  Seed: NQPLTFALQLHDPSGYL (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYL

SEQ ID NO: 333123 - protein, 18 aa, Artificial Sequence
  Description of Artificial Sequence: Synthetic peptide
  Seed: NQPLTFALQLHDPSGYLA (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLA

SEQ ID NO: 333124 - protein, 18 aa, Artificial Sequence
  Description of Artificial Sequence: Synthetic peptide
  Seed: NQPLTFALQLHDPSGYLA (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLA

SEQ ID NO: 333125 - protein, 19 aa, Artificial Sequence
  Description of Artificial Sequence: Synthetic peptide
  Seed: NQPLTFALQLHDPSGYLAE (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAE

SEQ ID NO: 333126 - protein, 19 aa, Artificial Sequence
  Description of Artificial Sequence: Synthetic peptide
  Seed: NQPLTFALQLHDPSGYLAE (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAE

SEQ ID NO: 333127 - protein, 19 aa, Artificial Sequence
  Description of Artificial Sequence: Synthetic peptide
  Seed: NQPLTFALQLHDPSGYLAE (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAE

SEQ ID NO: 333128 - protein, 20 aa, Artificial Sequence
  Description of Artificial Sequence: Synthetic peptide
  Seed: NQPLTFALQLHDPSGYLAEA (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAEA

SEQ ID NO: 333129 - protein, 20 aa, Artificial Sequence
  Description of Artificial Sequence: Synthetic peptide
  Seed: NQPLTFALQLHDPSGYLAEA (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAEA

SEQ ID NO: 333130 - protein, 20 aa, Artificial Sequence
  Description of Artificial Sequence: Synthetic peptide
  Seed: NQPLTFALQLHDPSGYLAEA (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAEA

SEQ ID NO: 333131 - protein, 21 aa, Artificial Sequence
  Description of Artificial Sequence: Synthetic peptide
  Seed: NQPLTFALQLHDPSGYLAEAD (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAEAD

SEQ ID NO: 333132 - protein, 21 aa, Artificial Sequence
  Description of Artificial Sequence: Synthetic peptide
  Seed: NQPLTFALQLHDPSGYLAEAD (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAEAD

SEQ ID NO: 333133 - protein, 21 aa, Artificial Sequence
  Description of Artificial Sequence: Synthetic peptide
  Seed: NQPLTFALQLHDPSGYLAEAD (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAEAD

SEQ ID NO: 333134 - protein, 21 aa, Artificial Sequence
  Description of Artificial Sequence: Synthetic peptide
  Seed: NQPLTFALQLHDPSGYLAEAD (PMEL_HUMAN)
  Core: LHDPSGYLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQXHDXSXYLXEAD

SEQ ID NO: 333135 - protein, 22 aa, Artificial Sequence
  Description of Artificial Sequence: Synthetic peptide
  Seed: NQPLTFALQLHDPSGYLAEADL (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAEADL

SEQ ID NO: 333136 - protein, 22 aa, Artificial Sequence
  Description of Artificial Sequence: Synthetic peptide
  Seed: NQPLTFALQLHDPSGYLAEADL (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAEADL

SEQ ID NO: 333137 - protein, 22 aa, Artificial Sequence
  Description of Artificial Sequence: Synthetic peptide
  Seed: NQPLTFALQLHDPSGYLAEADL (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAEADL

SEQ ID NO: 333138 - protein, 22 aa, Artificial Sequence
  Description of Artificial Sequence: Synthetic peptide
  Seed: NQPLTFALQLHDPSGYLAEADL (PMEL_HUMAN)
  Core: LHDPSGYLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQXHDXSXYLXEADL

SEQ ID NO: 333139 - protein, 22 aa, Artificial Sequence
  Description of Artificial Sequence: Synthetic peptide
  Seed: NQPLTFALQLHDPSGYLAEADL (PMEL_HUMAN)
  Core: PSGYLAEAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQLHDXSGXLXEAXL

SEQ ID NO: 333140 - protein, 23 aa, Artificial Sequence
  Description of Artificial Sequence: Synthetic peptide
  Seed: NQPLTFALQLHDPSGYLAEADLS (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAEADLS

SEQ ID NO: 333141 - protein, 23 aa, Artificial Sequence
  Description of Artificial Sequence: Synthetic peptide
  Seed: NQPLTFALQLHDPSGYLAEADLS (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAEADLS

SEQ ID NO: 333142 - protein, 23 aa, Artificial Sequence
  Description of Artificial Sequence: Synthetic peptide
  Seed: NQPLTFALQLHDPSGYLAEADLS (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAEADLS

SEQ ID NO: 333143 - protein, 23 aa, Artificial Sequence
  Description of Artificial Sequence: Synthetic peptide
  Seed: NQPLTFALQLHDPSGYLAEADLS (PMEL_HUMAN)
  Core: LHDPSGYLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQXHDXSXYLXEADLS

SEQ ID NO: 333144 - protein, 23 aa, Artificial Sequence
  Description of Artificial Sequence: Synthetic peptide
  Seed: NQPLTFALQLHDPSGYLAEADLS (PMEL_HUMAN)
  Core: PSGYLAEAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQLHDXSGXLXEAXLS

SEQ ID NO: 333145 - protein, 24 aa, Artificial Sequence
  Description of Artificial Sequence: Synthetic peptide
  Seed: NQPLTFALQLHDPSGYLAEADLSY (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAEADLSY

SEQ ID NO: 333146 - protein, 24 aa, Artificial Sequence
  Description of Artificial Sequence: Synthetic peptide
  Seed: NQPLTFALQLHDPSGYLAEADLSY (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAEADLSY

SEQ ID NO: 333147 - protein, 24 aa, Artificial Sequence
  Description of Artificial Sequence: Synthetic peptide
  Seed: NQPLTFALQLHDPSGYLAEADLSY (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAEADLSY

SEQ ID NO: 333148 - protein, 24 aa, Artificial Sequence
  Description of Artificial Sequence: Synthetic peptide
  Seed: NQPLTFALQLHDPSGYLAEADLSY (PMEL_HUMAN)
  Core: LHDPSGYLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQXHDXSXYLXEADLSY

SEQ ID NO: 333149 - protein, 24 aa, Artificial Sequence
  Description of Artificial Sequence: Synthetic peptide
  Seed: NQPLTFALQLHDPSGYLAEADLSY (PMEL_HUMAN)
  Core: PSGYLAEAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQLHDXSGXLXEAXLSY

SEQ ID NO: 333150 - protein, 25 aa, Artificial Sequence
  Description of Artificial Sequence: Synthetic peptide
  Seed: NQPLTFALQLHDPSGYLAEADLSYT (PMEL_HUMAN)
  Core: LTFALQLHD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NQPXTFXLXLHXPSGYLAEADLSYT

SEQ ID NO: 333151 - protein, 25 aa, Artificial Sequence
  Description of Artificial Sequence: Synthetic peptide
  Seed: NQPLTFALQLHDPSGYLAEADLSYT (PMEL_HUMAN)
  Core: FALQLHDPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTXALXLXDPXGYLAEADLSYT

SEQ ID NO: 333152 - protein, 25 aa, Artificial Sequence
  Description of Artificial Sequence: Synthetic peptide
  Seed: NQPLTFALQLHDPSGYLAEADLSYT (PMEL_HUMAN)
  Core: LQLHDPSGY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFAXQLXDXSGXLAEADLSYT

SEQ ID NO: 333153 - protein, 25 aa, Artificial Sequence
  Description of Artificial Sequence: Synthetic peptide
  Seed: NQPLTFALQLHDPSGYLAEADLSYT (PMEL_HUMAN)
  Core: LHDPSGYLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQXHDXSXYLXEADLSYT

SEQ ID NO: 333154 - protein, 25 aa, Artificial Sequence
  Description of Artificial Sequence: Synthetic peptide
  Seed: NQPLTFALQLHDPSGYLAEADLSYT (PMEL_HUMAN)
  Core: PSGYLAEAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQLHDXSGXLXEAXLSYT

SEQ ID NO: 333155 - protein, 25 aa, Artificial Sequence
  Description of Artificial Sequence: Synthetic peptide
  Seed: NQPLTFALQLHDPSGYLAEADLSYT (PMEL_HUMAN)
  Core: YLAEADLSY
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
NQPLTFALQLHDPSGXLAXAXLSXT

SEQ ID NO: 333156 - protein, 15 aa, Artificial Sequence
  Description of Artificial Sequence: Synthetic peptide
  Seed: NRQLYPEWTEAQRLD (PMEL_HUMAN)
  Core: LYPEWTEAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NRQXYPXWXEAXRLD

SEQ ID NO: 333157 - protein, 20 aa, Artificial Sequence
  Description of Artificial Sequence: Synthetic peptide
  Seed: NRQLYPEWTEAQRLDCWRGG (PMEL_HUMAN)
  Core: LYPEWTEAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NRQXYPXWXEAXRLDCWRGG

SEQ ID NO: 333158 - protein, 25 aa, Artificial Sequence
  Description of Artificial Sequence: Synthetic peptide
  Seed: NRQLYPEWTEAQRLDCWRGGQVSLK (PMEL_HUMAN)
  Core: LYPEWTEAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NRQXYPXWXEAXRLDCWRGGQVSLK

SEQ ID NO: 333159 - protein, 13 aa, Artificial Sequence
  Description of Artificial Sequence: Synthetic peptide
  Seed: NSLAVVSTQLIMP (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMP

SEQ ID NO: 333160 - protein, 14 aa, Artificial Sequence
  Description of Artificial Sequence: Synthetic peptide
  Seed: NSLAVVSTQLIMPG (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMPG

SEQ ID NO: 333161 - protein, 15 aa, Artificial Sequence
  Description of Artificial Sequence: Synthetic peptide
  Seed: NSLAVVSTQLIMPGQ (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMPGQ

SEQ ID NO: 333162 - protein, 15 aa, Artificial Sequence
  Description of Artificial Sequence: Synthetic peptide
  Seed: NSLAVVSTQLIMPGQ (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQ

SEQ ID NO: 333163 - protein, 15 aa, Artificial Sequence
  Description of Artificial Sequence: Synthetic peptide
  Seed: NSLAVVSTQLIMPGQ (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQ

SEQ ID NO: 333164 - protein, 16 aa, Artificial Sequence
  Description of Artificial Sequence: Synthetic peptide
  Seed: NSLAVVSTQLIMPGQE (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMPGQE

SEQ ID NO: 333165 - protein, 16 aa, Artificial Sequence
  Description of Artificial Sequence: Synthetic peptide
  Seed: NSLAVVSTQLIMPGQE (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQE

SEQ ID NO: 333166 - protein, 16 aa, Artificial Sequence
  Description of Artificial Sequence: Synthetic peptide
  Seed: NSLAVVSTQLIMPGQE (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQE

SEQ ID NO: 333167 - protein, 17 aa, Artificial Sequence
  Description of Artificial Sequence: Synthetic peptide
  Seed: NSLAVVSTQLIMPGQEA (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMPGQEA

SEQ ID NO: 333168 - protein, 17 aa, Artificial Sequence
  Description of Artificial Sequence: Synthetic peptide
  Seed: NSLAVVSTQLIMPGQEA (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEA

SEQ ID NO: 333169 - protein, 17 aa, Artificial Sequence
  Description of Artificial Sequence: Synthetic peptide
  Seed: NSLAVVSTQLIMPGQEA (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEA

SEQ ID NO: 333170 - protein, 18 aa, Artificial Sequence
  Description of Artificial Sequence: Synthetic peptide
  Seed: NSLAVVSTQLIMPGQEAG (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAG

SEQ ID NO: 333171 - protein, 18 aa, Artificial Sequence
  Description of Artificial Sequence: Synthetic peptide
  Seed: NSLAVVSTQLIMPGQEAG (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAG

SEQ ID NO: 333172 - protein, 19 aa, Artificial Sequence
  Description of Artificial Sequence: Synthetic peptide
  Seed: NSLAVVSTQLIMPGQEAGL (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMPGQEAGL

SEQ ID NO: 333173 - protein, 19 aa, Artificial Sequence
  Description of Artificial Sequence: Synthetic peptide
  Seed: NSLAVVSTQLIMPGQEAGL (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGL

SEQ ID NO: 333174 - protein, 19 aa, Artificial Sequence
  Description of Artificial Sequence: Synthetic peptide
  Seed: NSLAVVSTQLIMPGQEAGL (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGL

SEQ ID NO: 333175 - protein, 19 aa, Artificial Sequence
  Description of Artificial Sequence: Synthetic peptide
  Seed: NSLAVVSTQLIMPGQEAGL (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGL

SEQ ID NO: 333176 - protein, 20 aa, Artificial Sequence
  Description of Artificial Sequence: Synthetic peptide
  Seed: NSLAVVSTQLIMPGQEAGLG (PMEL_HUMAN)
  Core: LAVVSTQLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
NSXAVXSXQLXMPGQEAGLG

SEQ ID NO: 333177 - protein, 20 aa, Artificial Sequence
  Description of Artificial Sequence: Synthetic peptide
  Seed: NSLAVVSTQLIMPGQEAGLG (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGLG

SEQ ID NO: 333178 - protein, 20 aa, Artificial Sequence
  Description of Artificial Sequence: Synthetic peptide
  Seed: NSLAVVSTQLIMPGQEAGLG (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGLG

SEQ ID NO: 333179 - protein, 20 aa, Artificial Sequence
  Description of Artificial Sequence: Synthetic peptide
  Seed: NSLAVVSTQLIMPGQEAGLG (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGLG

SEQ ID NO: 333180 - protein, 21 aa, Artificial Sequence
  Description of Artificial Sequence: Synthetic peptide
  Seed: NSLAVVSTQLIMPGQEAGLGQ (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGLGQ

SEQ ID NO: 333181 - protein, 21 aa, Artificial Sequence
  Description of Artificial Sequence: Synthetic peptide
  Seed: NSLAVVSTQLIMPGQEAGLGQ (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGLGQ

SEQ ID NO: 333182 - protein, 21 aa, Artificial Sequence
  Description of Artificial Sequence: Synthetic peptide
  Seed: NSLAVVSTQLIMPGQEAGLGQ (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGLGQ

SEQ ID NO: 333183 - protein, 22 aa, Artificial Sequence
  Description of Artificial Sequence: Synthetic peptide
  Seed: NSLAVVSTQLIMPGQEAGLGQV (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGLGQV

SEQ ID NO: 333184 - protein, 22 aa, Artificial Sequence
  Description of Artificial Sequence: Synthetic peptide
  Seed: NSLAVVSTQLIMPGQEAGLGQV (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGLGQV

SEQ ID NO: 333185 - protein, 22 aa, Artificial Sequence
  Description of Artificial Sequence: Synthetic peptide
  Seed: NSLAVVSTQLIMPGQEAGLGQV (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGLGQV

SEQ ID NO: 333186 - protein, 23 aa, Artificial Sequence
  Description of Artificial Sequence: Synthetic peptide
  Seed: NSLAVVSTQLIMPGQEAGLGQVP (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGLGQVP

SEQ ID NO: 333187 - protein, 23 aa, Artificial Sequence
  Description of Artificial Sequence: Synthetic peptide
  Seed: NSLAVVSTQLIMPGQEAGLGQVP (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGLGQVP

SEQ ID NO: 333188 - protein, 23 aa, Artificial Sequence
  Description of Artificial Sequence: Synthetic peptide
  Seed: NSLAVVSTQLIMPGQEAGLGQVP (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGLGQVP

SEQ ID NO: 333189 - protein, 24 aa, Artificial Sequence
  Description of Artificial Sequence: Synthetic peptide
  Seed: NSLAVVSTQLIMPGQEAGLGQVPL (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGLGQVPL

SEQ ID NO: 333190 - protein, 24 aa, Artificial Sequence
  Description of Artificial Sequence: Synthetic peptide
  Seed: NSLAVVSTQLIMPGQEAGLGQVPL (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGLGQVPL

SEQ ID NO: 333191 - protein, 24 aa, Artificial Sequence
  Description of Artificial Sequence: Synthetic peptide
  Seed: NSLAVVSTQLIMPGQEAGLGQVPL (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGLGQVPL

SEQ ID NO: 333192 - protein, 25 aa, Artificial Sequence
  Description of Artificial Sequence: Synthetic peptide
  Seed: NSLAVVSTQLIMPGQEAGLGQVPLI (PMEL_HUMAN)
  Core: VVSTQLIMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSLAXVSXQXIMXGQEAGLGQVPLI

SEQ ID NO: 333193 - protein, 25 aa, Artificial Sequence
  Description of Artificial Sequence: Synthetic peptide
  Seed: NSLAVVSTQLIMPGQEAGLGQVPLI (PMEL_HUMAN)
  Core: VSTQLIMPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVXSTXLXMPXQEAGLGQVPLI

SEQ ID NO: 333194 - protein, 25 aa, Artificial Sequence
  Description of Artificial Sequence: Synthetic peptide
  Seed: NSLAVVSTQLIMPGQEAGLGQVPLI (PMEL_HUMAN)
  Core: QLIMPGQEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTXLIXPXQEXGLGQVPLI

SEQ ID NO: 333195 - protein, 25 aa, Artificial Sequence
  Description of Artificial Sequence: Synthetic peptide
  Seed: NSLAVVSTQLIMPGQEAGLGQVPLI (PMEL_HUMAN)
  Core: IMPGQEAGL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
NSLAVVSTQLXMPXQXAGXGQVPLI

SEQ ID NO: 333196 - protein, 13 aa, Artificial Sequence
  Description of Artificial Sequence: Synthetic peptide
  Seed: NTIINGSQVWGGQ (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQ

SEQ ID NO: 333197 - protein, 14 aa, Artificial Sequence
  Description of Artificial Sequence: Synthetic peptide
  Seed: NTIINGSQVWGGQP (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQP

SEQ ID NO: 333198 - protein, 15 aa, Artificial Sequence
  Description of Artificial Sequence: Synthetic peptide
  Seed: NTIINGSQVWGGQPV (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPV

SEQ ID NO: 333199 - protein, 16 aa, Artificial Sequence
  Description of Artificial Sequence: Synthetic peptide
  Seed: NTIINGSQVWGGQPVY (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVY

SEQ ID NO: 333200 - protein, 17 aa, Artificial Sequence
  Description of Artificial Sequence: Synthetic peptide
  Seed: NTIINGSQVWGGQPVYP (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYP

SEQ ID NO: 333201 - protein, 18 aa, Artificial Sequence
  Description of Artificial Sequence: Synthetic peptide
  Seed: NTIINGSQVWGGQPVYPQ (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQ

SEQ ID NO: 333202 - protein, 19 aa, Artificial Sequence
  Description of Artificial Sequence: Synthetic peptide
  Seed: NTIINGSQVWGGQPVYPQE (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQE

SEQ ID NO: 333203 - protein, 19 aa, Artificial Sequence
  Description of Artificial Sequence: Synthetic peptide
  Seed: NTIINGSQVWGGQPVYPQE (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQE

SEQ ID NO: 333204 - protein, 20 aa, Artificial Sequence
  Description of Artificial Sequence: Synthetic peptide
  Seed: NTIINGSQVWGGQPVYPQET (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQET

SEQ ID NO: 333205 - protein, 20 aa, Artificial Sequence
  Description of Artificial Sequence: Synthetic peptide
  Seed: NTIINGSQVWGGQPVYPQET (PMEL_HUMAN)
  Core: SQVWGGQPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGXQVXGXQPXYPQET

SEQ ID NO: 333206 - protein, 20 aa, Artificial Sequence
  Description of Artificial Sequence: Synthetic peptide
  Seed: NTIINGSQVWGGQPVYPQET (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQET

SEQ ID NO: 333207 - protein, 21 aa, Artificial Sequence
  Description of Artificial Sequence: Synthetic peptide
  Seed: NTIINGSQVWGGQPVYPQETD (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQETD

SEQ ID NO: 333208 - protein, 21 aa, Artificial Sequence
  Description of Artificial Sequence: Synthetic peptide
  Seed: NTIINGSQVWGGQPVYPQETD (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQETD

SEQ ID NO: 333209 - protein, 21 aa, Artificial Sequence
  Description of Artificial Sequence: Synthetic peptide
  Seed: NTIINGSQVWGGQPVYPQETD (PMEL_HUMAN)
  Core: WGGQPVYPQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQVXGGXPXYPXETD

SEQ ID NO: 333210 - protein, 22 aa, Artificial Sequence
  Description of Artificial Sequence: Synthetic peptide
  Seed: NTIINGSQVWGGQPVYPQETDD (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQETDD

SEQ ID NO: 333211 - protein, 22 aa, Artificial Sequence
  Description of Artificial Sequence: Synthetic peptide
  Seed: NTIINGSQVWGGQPVYPQETDD (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQETDD

SEQ ID NO: 333212 - protein, 22 aa, Artificial Sequence
  Description of Artificial Sequence: Synthetic peptide
  Seed: NTIINGSQVWGGQPVYPQETDD (PMEL_HUMAN)
  Core: WGGQPVYPQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQVXGGXPXYPXETDD

SEQ ID NO: 333213 - protein, 23 aa, Artificial Sequence
  Description of Artificial Sequence: Synthetic peptide
  Seed: NTIINGSQVWGGQPVYPQETDDA (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQETDDA

SEQ ID NO: 333214 - protein, 23 aa, Artificial Sequence
  Description of Artificial Sequence: Synthetic peptide
  Seed: NTIINGSQVWGGQPVYPQETDDA (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQETDDA

SEQ ID NO: 333215 - protein, 23 aa, Artificial Sequence
  Description of Artificial Sequence: Synthetic peptide
  Seed: NTIINGSQVWGGQPVYPQETDDA (PMEL_HUMAN)
  Core: WGGQPVYPQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQVXGGXPXYPXETDDA

SEQ ID NO: 333216 - protein, 24 aa, Artificial Sequence
  Description of Artificial Sequence: Synthetic peptide
  Seed: NTIINGSQVWGGQPVYPQETDDAC (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQETDDAC

SEQ ID NO: 333217 - protein, 24 aa, Artificial Sequence
  Description of Artificial Sequence: Synthetic peptide
  Seed: NTIINGSQVWGGQPVYPQETDDAC (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQETDDAC

SEQ ID NO: 333218 - protein, 24 aa, Artificial Sequence
  Description of Artificial Sequence: Synthetic peptide
  Seed: NTIINGSQVWGGQPVYPQETDDAC (PMEL_HUMAN)
  Core: WGGQPVYPQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQVXGGXPXYPXETDDAC

SEQ ID NO: 333219 - protein, 25 aa, Artificial Sequence
  Description of Artificial Sequence: Synthetic peptide
  Seed: NTIINGSQVWGGQPVYPQETDDACI (PMEL_HUMAN)
  Core: INGSQVWGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTIXNGXQXWGXQPVYPQETDDACI

SEQ ID NO: 333220 - protein, 25 aa, Artificial Sequence
  Description of Artificial Sequence: Synthetic peptide
  Seed: NTIINGSQVWGGQPVYPQETDDACI (PMEL_HUMAN)
  Core: VWGGQPVYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQXWGXQXVYXQETDDACI

SEQ ID NO: 333221 - protein, 25 aa, Artificial Sequence
  Description of Artificial Sequence: Synthetic peptide
  Seed: NTIINGSQVWGGQPVYPQETDDACI (PMEL_HUMAN)
  Core: WGGQPVYPQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NTIINGSQVXGGXPXYPXETDDACI

SEQ ID NO: 333222 - protein, 13 aa, Artificial Sequence
  Description of Artificial Sequence: Synthetic peptide
  Seed: NTTAGQVPTTEVV (PMEL_HUMAN)
  Core: TTAGQVPTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
NXTAXQXPTXEVV

SEQ ID NO: 333223 - protein, 14 aa, Artificial Sequence
  Description of Artificial Sequence: Synthetic peptide
  Seed: NTTAGQVPTTEVVG (PMEL_HUMAN)
  Core: TTAGQVPTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
NXTAXQXPTXEVVG

SEQ ID NO: 333224 - protein, 15 aa, Artificial Sequence
  Description of Artificial Sequence: Synthetic peptide
  Seed: NTTAGQVPTTEVVGT (PMEL_HUMAN)
  Core: TTAGQVPTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
NXTAXQXPTXEVVGT

SEQ ID NO: 333225 - protein, 16 aa, Artificial Sequence
  Description of Artificial Sequence: Synthetic peptide
  Seed: NTTAGQVPTTEVVGTT (PMEL_HUMAN)
  Core: TTAGQVPTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
NXTAXQXPTXEVVGTT

SEQ ID NO: 333226 - protein, 17 aa, Artificial Sequence
  Description of Artificial Sequence: Synthetic peptide
  Seed: NTTAGQVPTTEVVGTTP (PMEL_HUMAN)
  Core: PTTEVVGTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVXTTXVXGTXP

SEQ ID NO: 333227 - protein, 18 aa, Artificial Sequence
  Description of Artificial Sequence: Synthetic peptide
  Seed: NTTAGQVPTTEVVGTTPG (PMEL_HUMAN)
  Core: PTTEVVGTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVXTTXVXGTXPG

SEQ ID NO: 333228 - protein, 19 aa, Artificial Sequence
  Description of Artificial Sequence: Synthetic peptide
  Seed: NTTAGQVPTTEVVGTTPGQ (PMEL_HUMAN)
  Core: PTTEVVGTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVXTTXVXGTXPGQ

SEQ ID NO: 333229 - protein, 20 aa, Artificial Sequence
  Description of Artificial Sequence: Synthetic peptide
  Seed: NTTAGQVPTTEVVGTTPGQA (PMEL_HUMAN)
  Core: PTTEVVGTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVXTTXVXGTXPGQA

SEQ ID NO: 333230 - protein, 20 aa, Artificial Sequence
  Description of Artificial Sequence: Synthetic peptide
  Seed: NTTAGQVPTTEVVGTTPGQA (PMEL_HUMAN)
  Core: VVGTTPGQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVPTTEXVGXTXGQX

SEQ ID NO: 333231 - protein, 21 aa, Artificial Sequence
  Description of Artificial Sequence: Synthetic peptide
  Seed: NTTAGQVPTTEVVGTTPGQAP (PMEL_HUMAN)
  Core: PTTEVVGTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVXTTXVXGTXPGQAP

SEQ ID NO: 333232 - protein, 21 aa, Artificial Sequence
  Description of Artificial Sequence: Synthetic peptide
  Seed: NTTAGQVPTTEVVGTTPGQAP (PMEL_HUMAN)
  Core: VVGTTPGQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVPTTEXVGXTXGQXP

SEQ ID NO: 333233 - protein, 22 aa, Artificial Sequence
  Description of Artificial Sequence: Synthetic peptide
  Seed: NTTAGQVPTTEVVGTTPGQAPT (PMEL_HUMAN)
  Core: PTTEVVGTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVXTTXVXGTXPGQAPT

SEQ ID NO: 333234 - protein, 22 aa, Artificial Sequence
  Description of Artificial Sequence: Synthetic peptide
  Seed: NTTAGQVPTTEVVGTTPGQAPT (PMEL_HUMAN)
  Core: VVGTTPGQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVPTTEXVGXTXGQXPT

SEQ ID NO: 333235 - protein, 23 aa, Artificial Sequence
  Description of Artificial Sequence: Synthetic peptide
  Seed: NTTAGQVPTTEVVGTTPGQAPTA (PMEL_HUMAN)
  Core: VVGTTPGQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVPTTEXVGXTXGQXPTA

SEQ ID NO: 333236 - protein, 24 aa, Artificial Sequence
  Description of Artificial Sequence: Synthetic peptide
  Seed: NTTAGQVPTTEVVGTTPGQAPTAE (PMEL_HUMAN)
  Core: VVGTTPGQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVPTTEXVGXTXGQXPTAE

SEQ ID NO: 333237 - protein, 25 aa, Artificial Sequence
  Description of Artificial Sequence: Synthetic peptide
  Seed: NTTAGQVPTTEVVGTTPGQAPTAEP (PMEL_HUMAN)
  Core: VVGTTPGQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NTTAGQVPTTEXVGXTXGQXPTAEP

SEQ ID NO: 333238 - protein, 13 aa, Artificial Sequence
  Description of Artificial Sequence: Synthetic peptide
  Seed: NVSLADTNSLAVV (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXV

SEQ ID NO: 333239 - protein, 14 aa, Artificial Sequence
  Description of Artificial Sequence: Synthetic peptide
  Seed: NVSLADTNSLAVVS (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVS

SEQ ID NO: 333240 - protein, 15 aa, Artificial Sequence
  Description of Artificial Sequence: Synthetic peptide
  Seed: NVSLADTNSLAVVST (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVST

SEQ ID NO: 333241 - protein, 15 aa, Artificial Sequence
  Description of Artificial Sequence: Synthetic peptide
  Seed: NVSLADTNSLAVVST (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXT

SEQ ID NO: 333242 - protein, 16 aa, Artificial Sequence
  Description of Artificial Sequence: Synthetic peptide
  Seed: NVSLADTNSLAVVSTQ (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQ

SEQ ID NO: 333243 - protein, 16 aa, Artificial Sequence
  Description of Artificial Sequence: Synthetic peptide
  Seed: NVSLADTNSLAVVSTQ (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQ

SEQ ID NO: 333244 - protein, 16 aa, Artificial Sequence
  Description of Artificial Sequence: Synthetic peptide
  Seed: NVSLADTNSLAVVSTQ (PMEL_HUMAN)
  Core: TNSLAVVST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADXNSXAXVSXQ

SEQ ID NO: 333245 - protein, 16 aa, Artificial Sequence
  Description of Artificial Sequence: Synthetic peptide
  Seed: NVSLADTNSLAVVSTQ (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTX

SEQ ID NO: 333246 - protein, 17 aa, Artificial Sequence
  Description of Artificial Sequence: Synthetic peptide
  Seed: NVSLADTNSLAVVSTQL (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQL

SEQ ID NO: 333247 - protein, 17 aa, Artificial Sequence
  Description of Artificial Sequence: Synthetic peptide
  Seed: NVSLADTNSLAVVSTQL (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQL

SEQ ID NO: 333248 - protein, 17 aa, Artificial Sequence
  Description of Artificial Sequence: Synthetic peptide
  Seed: NVSLADTNSLAVVSTQL (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXL

SEQ ID NO: 333249 - protein, 18 aa, Artificial Sequence
  Description of Artificial Sequence: Synthetic peptide
  Seed: NVSLADTNSLAVVSTQLI (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLI

SEQ ID NO: 333250 - protein, 18 aa, Artificial Sequence
  Description of Artificial Sequence: Synthetic peptide
  Seed: NVSLADTNSLAVVSTQLI (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQLI

SEQ ID NO: 333251 - protein, 18 aa, Artificial Sequence
  Description of Artificial Sequence: Synthetic peptide
  Seed: NVSLADTNSLAVVSTQLI (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLI

SEQ ID NO: 333252 - protein, 19 aa, Artificial Sequence
  Description of Artificial Sequence: Synthetic peptide
  Seed: NVSLADTNSLAVVSTQLIM (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIM

SEQ ID NO: 333253 - protein, 19 aa, Artificial Sequence
  Description of Artificial Sequence: Synthetic peptide
  Seed: NVSLADTNSLAVVSTQLIM (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQLIM

SEQ ID NO: 333254 - protein, 19 aa, Artificial Sequence
  Description of Artificial Sequence: Synthetic peptide
  Seed: NVSLADTNSLAVVSTQLIM (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIM

SEQ ID NO: 333255 - protein, 19 aa, Artificial Sequence
  Description of Artificial Sequence: Synthetic peptide
  Seed: NVSLADTNSLAVVSTQLIM (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXM

SEQ ID NO: 333256 - protein, 20 aa, Artificial Sequence
  Description of Artificial Sequence: Synthetic peptide
  Seed: NVSLADTNSLAVVSTQLIMP (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIMP

SEQ ID NO: 333257 - protein, 20 aa, Artificial Sequence
  Description of Artificial Sequence: Synthetic peptide
  Seed: NVSLADTNSLAVVSTQLIMP (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQLIMP

SEQ ID NO: 333258 - protein, 20 aa, Artificial Sequence
  Description of Artificial Sequence: Synthetic peptide
  Seed: NVSLADTNSLAVVSTQLIMP (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIMP

SEQ ID NO: 333259 - protein, 20 aa, Artificial Sequence
  Description of Artificial Sequence: Synthetic peptide
  Seed: NVSLADTNSLAVVSTQLIMP (PMEL_HUMAN)
  Core: SLAVVSTQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNXLAXVXTQXIMP

SEQ ID NO: 333260 - protein, 20 aa, Artificial Sequence
  Description of Artificial Sequence: Synthetic peptide
  Seed: NVSLADTNSLAVVSTQLIMP (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXMP

SEQ ID NO: 333261 - protein, 21 aa, Artificial Sequence
  Description of Artificial Sequence: Synthetic peptide
  Seed: NVSLADTNSLAVVSTQLIMPG (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIMPG

SEQ ID NO: 333262 - protein, 21 aa, Artificial Sequence
  Description of Artificial Sequence: Synthetic peptide
  Seed: NVSLADTNSLAVVSTQLIMPG (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQLIMPG

SEQ ID NO: 333263 - protein, 21 aa, Artificial Sequence
  Description of Artificial Sequence: Synthetic peptide
  Seed: NVSLADTNSLAVVSTQLIMPG (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIMPG

SEQ ID NO: 333264 - protein, 21 aa, Artificial Sequence
  Description of Artificial Sequence: Synthetic peptide
  Seed: NVSLADTNSLAVVSTQLIMPG (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXMPG

SEQ ID NO: 333265 - protein, 22 aa, Artificial Sequence
  Description of Artificial Sequence: Synthetic peptide
  Seed: NVSLADTNSLAVVSTQLIMPGQ (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIMPGQ

SEQ ID NO: 333266 - protein, 22 aa, Artificial Sequence
  Description of Artificial Sequence: Synthetic peptide
  Seed: NVSLADTNSLAVVSTQLIMPGQ (PMEL_HUMAN)
  Core: DTNSLAVVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
NVSLAXTNXLXVVXTQLIMPGQ

SEQ ID NO: 333267 - protein, 22 aa, Artificial Sequence
  Description of Artificial Sequence: Synthetic peptide
  Seed: NVSLADTNSLAVVSTQLIMPGQ (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIMPGQ

SEQ ID NO: 333268 - protein, 22 aa, Artificial Sequence
  Description of Artificial Sequence: Synthetic peptide
  Seed: NVSLADTNSLAVVSTQLIMPGQ (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXMPGQ

SEQ ID NO: 333269 - protein, 22 aa, Artificial Sequence
  Description of Artificial Sequence: Synthetic peptide
  Seed: NVSLADTNSLAVVSTQLIMPGQ (PMEL_HUMAN)
  Core: VSTQLIMPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAVXSTXLXMPXQ

SEQ ID NO: 333270 - protein, 23 aa, Artificial Sequence
  Description of Artificial Sequence: Synthetic peptide
  Seed: NVSLADTNSLAVVSTQLIMPGQE (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIMPGQE

SEQ ID NO: 333271 - protein, 23 aa, Artificial Sequence
  Description of Artificial Sequence: Synthetic peptide
  Seed: NVSLADTNSLAVVSTQLIMPGQE (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIMPGQE

SEQ ID NO: 333272 - protein, 23 aa, Artificial Sequence
  Description of Artificial Sequence: Synthetic peptide
  Seed: NVSLADTNSLAVVSTQLIMPGQE (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXMPGQE

SEQ ID NO: 333273 - protein, 23 aa, Artificial Sequence
  Description of Artificial Sequence: Synthetic peptide
  Seed: NVSLADTNSLAVVSTQLIMPGQE (PMEL_HUMAN)
  Core: VVSTQLIMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAXVSXQXIMXGQE

SEQ ID NO: 333274 - protein, 23 aa, Artificial Sequence
  Description of Artificial Sequence: Synthetic peptide
  Seed: NVSLADTNSLAVVSTQLIMPGQE (PMEL_HUMAN)
  Core: VSTQLIMPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAVXSTXLXMPXQE

SEQ ID NO: 333275 - protein, 24 aa, Artificial Sequence
  Description of Artificial Sequence: Synthetic peptide
  Seed: NVSLADTNSLAVVSTQLIMPGQEA (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIMPGQEA

SEQ ID NO: 333276 - protein, 24 aa, Artificial Sequence
  Description of Artificial Sequence: Synthetic peptide
  Seed: NVSLADTNSLAVVSTQLIMPGQEA (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIMPGQEA

SEQ ID NO: 333277 - protein, 24 aa, Artificial Sequence
  Description of Artificial Sequence: Synthetic peptide
  Seed: NVSLADTNSLAVVSTQLIMPGQEA (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXMPGQEA

SEQ ID NO: 333278 - protein, 24 aa, Artificial Sequence
  Description of Artificial Sequence: Synthetic peptide
  Seed: NVSLADTNSLAVVSTQLIMPGQEA (PMEL_HUMAN)
  Core: VVSTQLIMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAXVSXQXIMXGQEA

SEQ ID NO: 333279 - protein, 24 aa, Artificial Sequence
  Description of Artificial Sequence: Synthetic peptide
  Seed: NVSLADTNSLAVVSTQLIMPGQEA (PMEL_HUMAN)
  Core: VSTQLIMPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAVXSTXLXMPXQEA

SEQ ID NO: 333280 - protein, 25 aa, Artificial Sequence
  Description of Artificial Sequence: Synthetic peptide
  Seed: NVSLADTNSLAVVSTQLIMPGQEAG (PMEL_HUMAN)
  Core: LADTNSLAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NVSXADXNXLAXVSTQLIMPGQEAG

SEQ ID NO: 333281 - protein, 25 aa, Artificial Sequence
  Description of Artificial Sequence: Synthetic peptide
  Seed: NVSLADTNSLAVVSTQLIMPGQEAG (PMEL_HUMAN)
  Core: NSLAVVSTQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTXSLXVXSTXLIMPGQEAG

SEQ ID NO: 333282 - protein, 25 aa, Artificial Sequence
  Description of Artificial Sequence: Synthetic peptide
  Seed: NVSLADTNSLAVVSTQLIMPGQEAG (PMEL_HUMAN)
  Core: LAVVSTQLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSXAVXSXQLXMPGQEAG

SEQ ID NO: 333283 - protein, 25 aa, Artificial Sequence
  Description of Artificial Sequence: Synthetic peptide
  Seed: NVSLADTNSLAVVSTQLIMPGQEAG (PMEL_HUMAN)
  Core: VVSTQLIMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAXVSXQXIMXGQEAG

SEQ ID NO: 333284 - protein, 25 aa, Artificial Sequence
  Description of Artificial Sequence: Synthetic peptide
  Seed: NVSLADTNSLAVVSTQLIMPGQEAG (PMEL_HUMAN)
  Core: VSTQLIMPG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
NVSLADTNSLAVXSTXLXMPXQEAG

SEQ ID NO: 333285 - protein, 13 aa, Artificial Sequence
  Description of Artificial Sequence: Synthetic peptide
  Seed: PACQLVLHQILKG (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKX

SEQ ID NO: 333286 - protein, 14 aa, Artificial Sequence
  Description of Artificial Sequence: Synthetic peptide
  Seed: PACQLVLHQILKGG (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXG

SEQ ID NO: 333287 - protein, 15 aa, Artificial Sequence
  Description of Artificial Sequence: Synthetic peptide
  Seed: PACQLVLHQILKGGS (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGS

SEQ ID NO: 333288 - protein, 16 aa, Artificial Sequence
  Description of Artificial Sequence: Synthetic peptide
  Seed: PACQLVLHQILKGGSG (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSG

SEQ ID NO: 333289 - protein, 16 aa, Artificial Sequence
  Description of Artificial Sequence: Synthetic peptide
  Seed: PACQLVLHQILKGGSG (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXG

SEQ ID NO: 333290 - protein, 17 aa, Artificial Sequence
  Description of Artificial Sequence: Synthetic peptide
  Seed: PACQLVLHQILKGGSGT (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGT

SEQ ID NO: 333291 - protein, 17 aa, Artificial Sequence
  Description of Artificial Sequence: Synthetic peptide
  Seed: PACQLVLHQILKGGSGT (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGT

SEQ ID NO: 333292 - protein, 18 aa, Artificial Sequence
  Description of Artificial Sequence: Synthetic peptide
  Seed: PACQLVLHQILKGGSGTY (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTY

SEQ ID NO: 333293 - protein, 18 aa, Artificial Sequence
  Description of Artificial Sequence: Synthetic peptide
  Seed: PACQLVLHQILKGGSGTY (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTY

SEQ ID NO: 333294 - protein, 19 aa, Artificial Sequence
  Description of Artificial Sequence: Synthetic peptide
  Seed: PACQLVLHQILKGGSGTYC (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYC

SEQ ID NO: 333295 - protein, 19 aa, Artificial Sequence
  Description of Artificial Sequence: Synthetic peptide
  Seed: PACQLVLHQILKGGSGTYC (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYC

SEQ ID NO: 333296 - protein, 20 aa, Artificial Sequence
  Description of Artificial Sequence: Synthetic peptide
  Seed: PACQLVLHQILKGGSGTYCL (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYCL

SEQ ID NO: 333297 - protein, 20 aa, Artificial Sequence
  Description of Artificial Sequence: Synthetic peptide
  Seed: PACQLVLHQILKGGSGTYCL (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYCL

SEQ ID NO: 333298 - protein, 21 aa, Artificial Sequence
  Description of Artificial Sequence: Synthetic peptide
  Seed: PACQLVLHQILKGGSGTYCLN (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYCLN

SEQ ID NO: 333299 - protein, 21 aa, Artificial Sequence
  Description of Artificial Sequence: Synthetic peptide
  Seed: PACQLVLHQILKGGSGTYCLN (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYCLN

SEQ ID NO: 333300 - protein, 22 aa, Artificial Sequence
  Description of Artificial Sequence: Synthetic peptide
  Seed: PACQLVLHQILKGGSGTYCLNV (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYCLNV

SEQ ID NO: 333301 - protein, 22 aa, Artificial Sequence
  Description of Artificial Sequence: Synthetic peptide
  Seed: PACQLVLHQILKGGSGTYCLNV (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYCLNV

SEQ ID NO: 333302 - protein, 23 aa, Artificial Sequence
  Description of Artificial Sequence: Synthetic peptide
  Seed: PACQLVLHQILKGGSGTYCLNVS (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYCLNVS

SEQ ID NO: 333303 - protein, 23 aa, Artificial Sequence
  Description of Artificial Sequence: Synthetic peptide
  Seed: PACQLVLHQILKGGSGTYCLNVS (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYCLNVS

SEQ ID NO: 333304 - protein, 23 aa, Artificial Sequence
  Description of Artificial Sequence: Synthetic peptide
  Seed: PACQLVLHQILKGGSGTYCLNVS (PMEL_HUMAN)
  Core: LKGGSGTYC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVLHQIXKGXSXTYXLNVS

SEQ ID NO: 333305 - protein, 24 aa, Artificial Sequence
  Description of Artificial Sequence: Synthetic peptide
  Seed: PACQLVLHQILKGGSGTYCLNVSL (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYCLNVSL

SEQ ID NO: 333306 - protein, 24 aa, Artificial Sequence
  Description of Artificial Sequence: Synthetic peptide
  Seed: PACQLVLHQILKGGSGTYCLNVSL (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYCLNVSL

SEQ ID NO: 333307 - protein, 24 aa, Artificial Sequence
  Description of Artificial Sequence: Synthetic peptide
  Seed: PACQLVLHQILKGGSGTYCLNVSL (PMEL_HUMAN)
  Core: LKGGSGTYC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVLHQIXKGXSXTYXLNVSL

SEQ ID NO: 333308 - protein, 25 aa, Artificial Sequence
  Description of Artificial Sequence: Synthetic peptide
  Seed: PACQLVLHQILKGGSGTYCLNVSLA (PMEL_HUMAN)
  Core: LVLHQILKG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PACQXVLXQXLKXGSGTYCLNVSLA

SEQ ID NO: 333309 - protein, 25 aa, Artificial Sequence
  Description of Artificial Sequence: Synthetic peptide
  Seed: PACQLVLHQILKGGSGTYCLNVSLA (PMEL_HUMAN)
  Core: LHQILKGGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVXHQXLXGGXGTYCLNVSLA

SEQ ID NO: 333310 - protein, 25 aa, Artificial Sequence
  Description of Artificial Sequence: Synthetic peptide
  Seed: PACQLVLHQILKGGSGTYCLNVSLA (PMEL_HUMAN)
  Core: LKGGSGTYC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PACQLVLHQIXKGXSXTYXLNVSLA

SEQ ID NO: 333311 - protein, 14 aa, Artificial Sequence
  Description of Artificial Sequence: Synthetic peptide
  Seed: PAEVSIVVLSGTTA (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTX

SEQ ID NO: 333312 - protein, 15 aa, Artificial Sequence
  Description of Artificial Sequence: Synthetic peptide
  Seed: PAEVSIVVLSGTTAA (PMEL_HUMAN)
  Core: EVSIVVLSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PAXVSXVXLSXTTAA

SEQ ID NO: 333313 - protein, 15 aa, Artificial Sequence
  Description of Artificial Sequence: Synthetic peptide
  Seed: PAEVSIVVLSGTTAA (PMEL_HUMAN)
  Core: VSIVVLSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAEXSIXVXSGXTAA

SEQ ID NO: 333314 - protein, 15 aa, Artificial Sequence
  Description of Artificial Sequence: Synthetic peptide
  Seed: PAEVSIVVLSGTTAA (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXA

SEQ ID NO: 333315 - protein, 16 aa, Artificial Sequence
  Description of Artificial Sequence: Synthetic peptide
  Seed: PAEVSIVVLSGTTAAQ (PMEL_HUMAN)
  Core: EVSIVVLSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PAXVSXVXLSXTTAAQ

SEQ ID NO: 333316 - protein, 16 aa, Artificial Sequence
  Description of Artificial Sequence: Synthetic peptide
  Seed: PAEVSIVVLSGTTAAQ (PMEL_HUMAN)
  Core: VSIVVLSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAEXSIXVXSGXTAAQ

SEQ ID NO: 333317 - protein, 16 aa, Artificial Sequence
  Description of Artificial Sequence: Synthetic peptide
  Seed: PAEVSIVVLSGTTAAQ (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQ

SEQ ID NO: 333318 - protein, 16 aa, Artificial Sequence
  Description of Artificial Sequence: Synthetic peptide
  Seed: PAEVSIVVLSGTTAAQ (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQ

SEQ ID NO: 333319 - protein, 16 aa, Artificial Sequence
  Description of Artificial Sequence: Synthetic peptide
  Seed: PAEVSIVVLSGTTAAQ (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAX

SEQ ID NO: 333320 - protein, 17 aa, Artificial Sequence
  Description of Artificial Sequence: Synthetic peptide
  Seed: PAEVSIVVLSGTTAAQV (PMEL_HUMAN)
  Core: EVSIVVLSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PAXVSXVXLSXTTAAQV

SEQ ID NO: 333321 - protein, 17 aa, Artificial Sequence
  Description of Artificial Sequence: Synthetic peptide
  Seed: PAEVSIVVLSGTTAAQV (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQV

SEQ ID NO: 333322 - protein, 17 aa, Artificial Sequence
  Description of Artificial Sequence: Synthetic peptide
  Seed: PAEVSIVVLSGTTAAQV (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXV

SEQ ID NO: 333323 - protein, 17 aa, Artificial Sequence
  Description of Artificial Sequence: Synthetic peptide
  Seed: PAEVSIVVLSGTTAAQV (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQX

SEQ ID NO: 333324 - protein, 18 aa, Artificial Sequence
  Description of Artificial Sequence: Synthetic peptide
  Seed: PAEVSIVVLSGTTAAQVT (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVT

SEQ ID NO: 333325 - protein, 18 aa, Artificial Sequence
  Description of Artificial Sequence: Synthetic peptide
  Seed: PAEVSIVVLSGTTAAQVT (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVT

SEQ ID NO: 333326 - protein, 18 aa, Artificial Sequence
  Description of Artificial Sequence: Synthetic peptide
  Seed: PAEVSIVVLSGTTAAQVT (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVT

SEQ ID NO: 333327 - protein, 18 aa, Artificial Sequence
  Description of Artificial Sequence: Synthetic peptide
  Seed: PAEVSIVVLSGTTAAQVT (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXT

SEQ ID NO: 333328 - protein, 19 aa, Artificial Sequence
  Description of Artificial Sequence: Synthetic peptide
  Seed: PAEVSIVVLSGTTAAQVTT (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTT

SEQ ID NO: 333329 - protein, 19 aa, Artificial Sequence
  Description of Artificial Sequence: Synthetic peptide
  Seed: PAEVSIVVLSGTTAAQVTT (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTT

SEQ ID NO: 333330 - protein, 19 aa, Artificial Sequence
  Description of Artificial Sequence: Synthetic peptide
  Seed: PAEVSIVVLSGTTAAQVTT (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTT

SEQ ID NO: 333331 - protein, 19 aa, Artificial Sequence
  Description of Artificial Sequence: Synthetic peptide
  Seed: PAEVSIVVLSGTTAAQVTT (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTT

SEQ ID NO: 333332 - protein, 20 aa, Artificial Sequence
  Description of Artificial Sequence: Synthetic peptide
  Seed: PAEVSIVVLSGTTAAQVTTT (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTTT

SEQ ID NO: 333333 - protein, 20 aa, Artificial Sequence
  Description of Artificial Sequence: Synthetic peptide
  Seed: PAEVSIVVLSGTTAAQVTTT (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTTT

SEQ ID NO: 333334 - protein, 20 aa, Artificial Sequence
  Description of Artificial Sequence: Synthetic peptide
  Seed: PAEVSIVVLSGTTAAQVTTT (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTTT

SEQ ID NO: 333335 - protein, 20 aa, Artificial Sequence
  Description of Artificial Sequence: Synthetic peptide
  Seed: PAEVSIVVLSGTTAAQVTTT (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTTT

SEQ ID NO: 333336 - protein, 21 aa, Artificial Sequence
  Description of Artificial Sequence: Synthetic peptide
  Seed: PAEVSIVVLSGTTAAQVTTTE (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTTTE

SEQ ID NO: 333337 - protein, 21 aa, Artificial Sequence
  Description of Artificial Sequence: Synthetic peptide
  Seed: PAEVSIVVLSGTTAAQVTTTE (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTTTE

SEQ ID NO: 333338 - protein, 21 aa, Artificial Sequence
  Description of Artificial Sequence: Synthetic peptide
  Seed: PAEVSIVVLSGTTAAQVTTTE (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTTTE

SEQ ID NO: 333339 - protein, 21 aa, Artificial Sequence
  Description of Artificial Sequence: Synthetic peptide
  Seed: PAEVSIVVLSGTTAAQVTTTE (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTTTE

SEQ ID NO: 333340 - protein, 22 aa, Artificial Sequence
  Description of Artificial Sequence: Synthetic peptide
  Seed: PAEVSIVVLSGTTAAQVTTTEW (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTTTEW

SEQ ID NO: 333341 - protein, 22 aa, Artificial Sequence
  Description of Artificial Sequence: Synthetic peptide
  Seed: PAEVSIVVLSGTTAAQVTTTEW (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTTTEW

SEQ ID NO: 333342 - protein, 22 aa, Artificial Sequence
  Description of Artificial Sequence: Synthetic peptide
  Seed: PAEVSIVVLSGTTAAQVTTTEW (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTTTEW

SEQ ID NO: 333343 - protein, 22 aa, Artificial Sequence
  Description of Artificial Sequence: Synthetic peptide
  Seed: PAEVSIVVLSGTTAAQVTTTEW (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTTTEW

SEQ ID NO: 333344 - protein, 22 aa, Artificial Sequence
  Description of Artificial Sequence: Synthetic peptide
  Seed: PAEVSIVVLSGTTAAQVTTTEW (PMEL_HUMAN)
  Core: TTAAQVTTT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVLSGXTAXQXTTXEW

SEQ ID NO: 333345 - protein, 23 aa, Artificial Sequence
  Description of Artificial Sequence: Synthetic peptide
  Seed: PAEVSIVVLSGTTAAQVTTTEWV (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTTTEWV

SEQ ID NO: 333346 - protein, 23 aa, Artificial Sequence
  Description of Artificial Sequence: Synthetic peptide
  Seed: PAEVSIVVLSGTTAAQVTTTEWV (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTTTEWV

SEQ ID NO: 333347 - protein, 23 aa, Artificial Sequence
  Description of Artificial Sequence: Synthetic peptide
  Seed: PAEVSIVVLSGTTAAQVTTTEWV (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTTTEWV

SEQ ID NO: 333348 - protein, 23 aa, Artificial Sequence
  Description of Artificial Sequence: Synthetic peptide
  Seed: PAEVSIVVLSGTTAAQVTTTEWV (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTTTEWV

SEQ ID NO: 333349 - protein, 23 aa, Artificial Sequence
  Description of Artificial Sequence: Synthetic peptide
  Seed: PAEVSIVVLSGTTAAQVTTTEWV (PMEL_HUMAN)
  Core: TTAAQVTTT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVLSGXTAXQXTTXEWV

SEQ ID NO: 333350 - protein, 24 aa, Artificial Sequence
  Description of Artificial Sequence: Synthetic peptide
  Seed: PAEVSIVVLSGTTAAQVTTTEWVE (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTTTEWVE

SEQ ID NO: 333351 - protein, 24 aa, Artificial Sequence
  Description of Artificial Sequence: Synthetic peptide
  Seed: PAEVSIVVLSGTTAAQVTTTEWVE (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTTTEWVE

SEQ ID NO: 333352 - protein, 24 aa, Artificial Sequence
  Description of Artificial Sequence: Synthetic peptide
  Seed: PAEVSIVVLSGTTAAQVTTTEWVE (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTTTEWVE

SEQ ID NO: 333353 - protein, 24 aa, Artificial Sequence
  Description of Artificial Sequence: Synthetic peptide
  Seed: PAEVSIVVLSGTTAAQVTTTEWVE (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTTTEWVE

SEQ ID NO: 333354 - protein, 24 aa, Artificial Sequence
  Description of Artificial Sequence: Synthetic peptide
  Seed: PAEVSIVVLSGTTAAQVTTTEWVE (PMEL_HUMAN)
  Core: TTAAQVTTT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVLSGXTAXQXTTXEWVE

SEQ ID NO: 333355 - protein, 25 aa, Artificial Sequence
  Description of Artificial Sequence: Synthetic peptide
  Seed: PAEVSIVVLSGTTAAQVTTTEWVET (PMEL_HUMAN)
  Core: IVVLSGTTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSXVVXSXTTXAQVTTTEWVET

SEQ ID NO: 333356 - protein, 25 aa, Artificial Sequence
  Description of Artificial Sequence: Synthetic peptide
  Seed: PAEVSIVVLSGTTAAQVTTTEWVET (PMEL_HUMAN)
  Core: VVLSGTTAA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIXVLXGXTAXQVTTTEWVET

SEQ ID NO: 333357 - protein, 25 aa, Artificial Sequence
  Description of Artificial Sequence: Synthetic peptide
  Seed: PAEVSIVVLSGTTAAQVTTTEWVET (PMEL_HUMAN)
  Core: VLSGTTAAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVXLSXTXAAXVTTTEWVET

SEQ ID NO: 333358 - protein, 25 aa, Artificial Sequence
  Description of Artificial Sequence: Synthetic peptide
  Seed: PAEVSIVVLSGTTAAQVTTTEWVET (PMEL_HUMAN)
  Core: LSGTTAAQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVXSGXTXAQXTTTEWVET

SEQ ID NO: 333359 - protein, 25 aa, Artificial Sequence
  Description of Artificial Sequence: Synthetic peptide
  Seed: PAEVSIVVLSGTTAAQVTTTEWVET (PMEL_HUMAN)
  Core: TTAAQVTTT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PAEVSIVVLSGXTAXQXTTXEWVET

SEQ ID NO: 333360 - protein, 15 aa, Artificial Sequence
  Description of Artificial Sequence: Synthetic peptide
  Seed: PAQRLCQPVLPSPAC (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPAC

SEQ ID NO: 333361 - protein, 17 aa, Artificial Sequence
  Description of Artificial Sequence: Synthetic peptide
  Seed: PAQRLCQPVLPSPACQL (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPACQL

SEQ ID NO: 333362 - protein, 17 aa, Artificial Sequence
  Description of Artificial Sequence: Synthetic peptide
  Seed: PAQRLCQPVLPSPACQL (PMEL_HUMAN)
  Core: CQPVLPSPA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLXQPXLXSPXCQL

SEQ ID NO: 333363 - protein, 19 aa, Artificial Sequence
  Description of Artificial Sequence: Synthetic peptide
  Seed: PAQRLCQPVLPSPACQLVL (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPACQLVL

SEQ ID NO: 333364 - protein, 19 aa, Artificial Sequence
  Description of Artificial Sequence: Synthetic peptide
  Seed: PAQRLCQPVLPSPACQLVL (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVL

SEQ ID NO: 333365 - protein, 20 aa, Artificial Sequence
  Description of Artificial Sequence: Synthetic peptide
  Seed: PAQRLCQPVLPSPACQLVLH (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPACQLVLH

SEQ ID NO: 333366 - protein, 20 aa, Artificial Sequence
  Description of Artificial Sequence: Synthetic peptide
  Seed: PAQRLCQPVLPSPACQLVLH (PMEL_HUMAN)
  Core: CQPVLPSPA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLXQPXLXSPXCQLVLH

SEQ ID NO: 333367 - protein, 20 aa, Artificial Sequence
  Description of Artificial Sequence: Synthetic peptide
  Seed: PAQRLCQPVLPSPACQLVLH (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVLH

SEQ ID NO: 333368 - protein, 21 aa, Artificial Sequence
  Description of Artificial Sequence: Synthetic peptide
  Seed: PAQRLCQPVLPSPACQLVLHQ (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVLHQ

SEQ ID NO: 333369 - protein, 22 aa, Artificial Sequence
  Description of Artificial Sequence: Synthetic peptide
  Seed: PAQRLCQPVLPSPACQLVLHQI (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVLHQI

SEQ ID NO: 333370 - protein, 23 aa, Artificial Sequence
  Description of Artificial Sequence: Synthetic peptide
  Seed: PAQRLCQPVLPSPACQLVLHQIL (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPACQLVLHQIL

SEQ ID NO: 333371 - protein, 23 aa, Artificial Sequence
  Description of Artificial Sequence: Synthetic peptide
  Seed: PAQRLCQPVLPSPACQLVLHQIL (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVLHQIL

SEQ ID NO: 333372 - protein, 24 aa, Artificial Sequence
  Description of Artificial Sequence: Synthetic peptide
  Seed: PAQRLCQPVLPSPACQLVLHQILK (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPACQLVLHQILK

SEQ ID NO: 333373 - protein, 24 aa, Artificial Sequence
  Description of Artificial Sequence: Synthetic peptide
  Seed: PAQRLCQPVLPSPACQLVLHQILK (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVLHQILK

SEQ ID NO: 333374 - protein, 24 aa, Artificial Sequence
  Description of Artificial Sequence: Synthetic peptide
  Seed: PAQRLCQPVLPSPACQLVLHQILK (PMEL_HUMAN)
  Core: PACQLVLHQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPVLPSXACXLXLHXILK

SEQ ID NO: 333375 - protein, 24 aa, Artificial Sequence
  Description of Artificial Sequence: Synthetic peptide
  Seed: PAQRLCQPVLPSPACQLVLHQILK (PMEL_HUMAN)
  Core: CQLVLHQIL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPVLPSPAXQLXLXQIXK

SEQ ID NO: 333376 - protein, 25 aa, Artificial Sequence
  Description of Artificial Sequence: Synthetic peptide
  Seed: PAQRLCQPVLPSPACQLVLHQILKG (PMEL_HUMAN)
  Core: RLCQPVLPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PAQXLCXPXLPXPACQLVLHQILKG

SEQ ID NO: 333377 - protein, 25 aa, Artificial Sequence
  Description of Artificial Sequence: Synthetic peptide
  Seed: PAQRLCQPVLPSPACQLVLHQILKG (PMEL_HUMAN)
  Core: CQPVLPSPA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLXQPXLXSPXCQLVLHQILKG

SEQ ID NO: 333378 - protein, 25 aa, Artificial Sequence
  Description of Artificial Sequence: Synthetic peptide
  Seed: PAQRLCQPVLPSPACQLVLHQILKG (PMEL_HUMAN)
  Core: VLPSPACQL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPXLPXPXCQXVLHQILKG

SEQ ID NO: 333379 - protein, 25 aa, Artificial Sequence
  Description of Artificial Sequence: Synthetic peptide
  Seed: PAQRLCQPVLPSPACQLVLHQILKG (PMEL_HUMAN)
  Core: PACQLVLHQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPVLPSXACXLXLHXILKG

SEQ ID NO: 333380 - protein, 25 aa, Artificial Sequence
  Description of Artificial Sequence: Synthetic peptide
  Seed: PAQRLCQPVLPSPACQLVLHQILKG (PMEL_HUMAN)
  Core: ACQLVLHQI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPVLPSPXCQXVXHQXLKG

SEQ ID NO: 333381 - protein, 25 aa, Artificial Sequence
  Description of Artificial Sequence: Synthetic peptide
  Seed: PAQRLCQPVLPSPACQLVLHQILKG (PMEL_HUMAN)
  Core: CQLVLHQIL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPVLPSPAXQLXLXQIXKG

SEQ ID NO: 333382 - protein, 25 aa, Artificial Sequence
  Description of Artificial Sequence: Synthetic peptide
  Seed: PAQRLCQPVLPSPACQLVLHQILKG (PMEL_HUMAN)
  Core: LVLHQILKG
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
PAQRLCQPVLPSPACQXVLXQXLKX

SEQ ID NO: 333383 - protein, 15 aa, Artificial Sequence
  Description of Artificial Sequence: Synthetic peptide
  Seed: PCPSGSWSQKRSFVY (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVX

SEQ ID NO: 333384 - protein, 17 aa, Artificial Sequence
  Description of Artificial Sequence: Synthetic peptide
  Seed: PCPSGSWSQKRSFVYVW (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVW

SEQ ID NO: 333385 - protein, 19 aa, Artificial Sequence
  Description of Artificial Sequence: Synthetic peptide
  Seed: PCPSGSWSQKRSFVYVWKT (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKT

SEQ ID NO: 333386 - protein, 19 aa, Artificial Sequence
  Description of Artificial Sequence: Synthetic peptide
  Seed: PCPSGSWSQKRSFVYVWKT (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKX

SEQ ID NO: 333387 - protein, 20 aa, Artificial Sequence
  Description of Artificial Sequence: Synthetic peptide
  Seed: PCPSGSWSQKRSFVYVWKTW (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKTW

SEQ ID NO: 333388 - protein, 20 aa, Artificial Sequence
  Description of Artificial Sequence: Synthetic peptide
  Seed: PCPSGSWSQKRSFVYVWKTW (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKXW

SEQ ID NO: 333389 - protein, 21 aa, Artificial Sequence
  Description of Artificial Sequence: Synthetic peptide
  Seed: PCPSGSWSQKRSFVYVWKTWG (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKTWG

SEQ ID NO: 333390 - protein, 21 aa, Artificial Sequence
  Description of Artificial Sequence: Synthetic peptide
  Seed: PCPSGSWSQKRSFVYVWKTWG (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKXWG

SEQ ID NO: 333391 - protein, 21 aa, Artificial Sequence
  Description of Artificial Sequence: Synthetic peptide
  Seed: PCPSGSWSQKRSFVYVWKTWG (PMEL_HUMAN)
  Core: FVYVWKTWG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSXVYXWXTWX

SEQ ID NO: 333392 - protein, 22 aa, Artificial Sequence
  Description of Artificial Sequence: Synthetic peptide
  Seed: PCPSGSWSQKRSFVYVWKTWGQ (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKTWGQ

SEQ ID NO: 333393 - protein, 22 aa, Artificial Sequence
  Description of Artificial Sequence: Synthetic peptide
  Seed: PCPSGSWSQKRSFVYVWKTWGQ (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKXWGQ

SEQ ID NO: 333394 - protein, 22 aa, Artificial Sequence
  Description of Artificial Sequence: Synthetic peptide
  Seed: PCPSGSWSQKRSFVYVWKTWGQ (PMEL_HUMAN)
  Core: FVYVWKTWG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSXVYXWXTWXQ

SEQ ID NO: 333395 - protein, 22 aa, Artificial Sequence
  Description of Artificial Sequence: Synthetic peptide
  Seed: PCPSGSWSQKRSFVYVWKTWGQ (PMEL_HUMAN)
  Core: VYVWKTWGQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFXYVXKXWGX

SEQ ID NO: 333396 - protein, 23 aa, Artificial Sequence
  Description of Artificial Sequence: Synthetic peptide
  Seed: PCPSGSWSQKRSFVYVWKTWGQY (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKTWGQY

SEQ ID NO: 333397 - protein, 23 aa, Artificial Sequence
  Description of Artificial Sequence: Synthetic peptide
  Seed: PCPSGSWSQKRSFVYVWKTWGQY (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKXWGQY

SEQ ID NO: 333398 - protein, 23 aa, Artificial Sequence
  Description of Artificial Sequence: Synthetic peptide
  Seed: PCPSGSWSQKRSFVYVWKTWGQY (PMEL_HUMAN)
  Core: FVYVWKTWG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSXVYXWXTWXQY

SEQ ID NO: 333399 - protein, 23 aa, Artificial Sequence
  Description of Artificial Sequence: Synthetic peptide
  Seed: PCPSGSWSQKRSFVYVWKTWGQY (PMEL_HUMAN)
  Core: VYVWKTWGQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFXYVXKXWGXY

SEQ ID NO: 333400 - protein, 23 aa, Artificial Sequence
  Description of Artificial Sequence: Synthetic peptide
  Seed: PCPSGSWSQKRSFVYVWKTWGQY (PMEL_HUMAN)
  Core: YVWKTWGQY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFVXVWXTXGQX

SEQ ID NO: 333401 - protein, 24 aa, Artificial Sequence
  Description of Artificial Sequence: Synthetic peptide
  Seed: PCPSGSWSQKRSFVYVWKTWGQYW (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKTWGQYW

SEQ ID NO: 333402 - protein, 24 aa, Artificial Sequence
  Description of Artificial Sequence: Synthetic peptide
  Seed: PCPSGSWSQKRSFVYVWKTWGQYW (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKXWGQYW

SEQ ID NO: 333403 - protein, 24 aa, Artificial Sequence
  Description of Artificial Sequence: Synthetic peptide
  Seed: PCPSGSWSQKRSFVYVWKTWGQYW (PMEL_HUMAN)
  Core: FVYVWKTWG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSXVYXWXTWXQYW

SEQ ID NO: 333404 - protein, 24 aa, Artificial Sequence
  Description of Artificial Sequence: Synthetic peptide
  Seed: PCPSGSWSQKRSFVYVWKTWGQYW (PMEL_HUMAN)
  Core: VYVWKTWGQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFXYVXKXWGXYW

SEQ ID NO: 333405 - protein, 24 aa, Artificial Sequence
  Description of Artificial Sequence: Synthetic peptide
  Seed: PCPSGSWSQKRSFVYVWKTWGQYW (PMEL_HUMAN)
  Core: YVWKTWGQY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFVXVWXTXGQXW

SEQ ID NO: 333406 - protein, 25 aa, Artificial Sequence
  Description of Artificial Sequence: Synthetic peptide
  Seed: PCPSGSWSQKRSFVYVWKTWGQYWQ (PMEL_HUMAN)
  Core: WSQKRSFVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSXSQXRXFVXVWKTWGQYWQ

SEQ ID NO: 333407 - protein, 25 aa, Artificial Sequence
  Description of Artificial Sequence: Synthetic peptide
  Seed: PCPSGSWSQKRSFVYVWKTWGQYWQ (PMEL_HUMAN)
  Core: RSFVYVWKT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKXSFXYXWKXWGQYWQ

SEQ ID NO: 333408 - protein, 25 aa, Artificial Sequence
  Description of Artificial Sequence: Synthetic peptide
  Seed: PCPSGSWSQKRSFVYVWKTWGQYWQ (PMEL_HUMAN)
  Core: FVYVWKTWG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSXVYXWXTWXQYWQ

SEQ ID NO: 333409 - protein, 25 aa, Artificial Sequence
  Description of Artificial Sequence: Synthetic peptide
  Seed: PCPSGSWSQKRSFVYVWKTWGQYWQ (PMEL_HUMAN)
  Core: VYVWKTWGQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFXYVXKXWGXYWQ

SEQ ID NO: 333410 - protein, 25 aa, Artificial Sequence
  Description of Artificial Sequence: Synthetic peptide
  Seed: PCPSGSWSQKRSFVYVWKTWGQYWQ (PMEL_HUMAN)
  Core: YVWKTWGQY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PCPSGSWSQKRSFVXVWXTXGQXWQ

SEQ ID NO: 333411 - protein, 14 aa, Artificial Sequence
  Description of Artificial Sequence: Synthetic peptide
  Seed: PDASSIMSTESITG (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITX

SEQ ID NO: 333412 - protein, 15 aa, Artificial Sequence
  Description of Artificial Sequence: Synthetic peptide
  Seed: PDASSIMSTESITGS (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITXS

SEQ ID NO: 333413 - protein, 16 aa, Artificial Sequence
  Description of Artificial Sequence: Synthetic peptide
  Seed: PDASSIMSTESITGSL (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITXSL

SEQ ID NO: 333414 - protein, 17 aa, Artificial Sequence
  Description of Artificial Sequence: Synthetic peptide
  Seed: PDASSIMSTESITGSLG (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITXSLG

SEQ ID NO: 333415 - protein, 19 aa, Artificial Sequence
  Description of Artificial Sequence: Synthetic peptide
  Seed: PDASSIMSTESITGSLGPL (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITXSLGPL

SEQ ID NO: 333416 - protein, 20 aa, Artificial Sequence
  Description of Artificial Sequence: Synthetic peptide
  Seed: PDASSIMSTESITGSLGPLL (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITXSLGPLL

SEQ ID NO: 333417 - protein, 20 aa, Artificial Sequence
  Description of Artificial Sequence: Synthetic peptide
  Seed: PDASSIMSTESITGSLGPLL (PMEL_HUMAN)
  Core: MSTESITGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDASSIXSTXSXTGXLGPLL

SEQ ID NO: 333418 - protein, 21 aa, Artificial Sequence
  Description of Artificial Sequence: Synthetic peptide
  Seed: PDASSIMSTESITGSLGPLLD (PMEL_HUMAN)
  Core: IMSTESITG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDASSXMSXEXITXSLGPLLD

SEQ ID NO: 333419 - protein, 21 aa, Artificial Sequence
  Description of Artificial Sequence: Synthetic peptide
  Seed: PDASSIMSTESITGSLGPLLD (PMEL_HUMAN)
  Core: ITGSLGPLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PDASSIMSTESXTGXLXPLXD

SEQ ID NO: 333420 - protein, 22 aa, Artificial Sequence
  Description of Artificial Sequence: Synthetic peptide
  Seed: PDASSIMSTESITGSLGPLLDG (PMEL_HUMAN)
  Core: ITGSLGPLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PDASSIMSTESXTGXLXPLXDG

SEQ ID NO: 333421 - protein, 23 aa, Artificial Sequence
  Description of Artificial Sequence: Synthetic peptide
  Seed: PDASSIMSTESITGSLGPLLDGT (PMEL_HUMAN)
  Core: ITGSLGPLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PDASSIMSTESXTGXLXPLXDGT

SEQ ID NO: 333422 - protein, 24 aa, Artificial Sequence
  Description of Artificial Sequence: Synthetic peptide
  Seed: PDASSIMSTESITGSLGPLLDGTA (PMEL_HUMAN)
  Core: ITGSLGPLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PDASSIMSTESXTGXLXPLXDGTA

SEQ ID NO: 333423 - protein, 25 aa, Artificial Sequence
  Description of Artificial Sequence: Synthetic peptide
  Seed: PDASSIMSTESITGSLGPLLDGTAT (PMEL_HUMAN)
  Core: ITGSLGPLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PDASSIMSTESXTGXLXPLXDGTAT

SEQ ID NO: 333424 - protein, 20 aa, Artificial Sequence
  Description of Artificial Sequence: Synthetic peptide
  Seed: PDGGPCPSGSWSQKRSFVYV (PMEL_HUMAN)
  Core: WSQKRSFVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSXSQXRXFVXV

SEQ ID NO: 333425 - protein, 21 aa, Artificial Sequence
  Description of Artificial Sequence: Synthetic peptide
  Seed: PDGGPCPSGSWSQKRSFVYVW (PMEL_HUMAN)
  Core: WSQKRSFVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSXSQXRXFVXVW

SEQ ID NO: 333426 - protein, 22 aa, Artificial Sequence
  Description of Artificial Sequence: Synthetic peptide
  Seed: PDGGPCPSGSWSQKRSFVYVWK (PMEL_HUMAN)
  Core: WSQKRSFVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSXSQXRXFVXVWK

SEQ ID NO: 333427 - protein, 23 aa, Artificial Sequence
  Description of Artificial Sequence: Synthetic peptide
  Seed: PDGGPCPSGSWSQKRSFVYVWKT (PMEL_HUMAN)
  Core: WSQKRSFVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSXSQXRXFVXVWKT

SEQ ID NO: 333428 - protein, 24 aa, Artificial Sequence
  Description of Artificial Sequence: Synthetic peptide
  Seed: PDGGPCPSGSWSQKRSFVYVWKTW (PMEL_HUMAN)
  Core: WSQKRSFVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSXSQXRXFVXVWKTW

SEQ ID NO: 333429 - protein, 24 aa, Artificial Sequence
  Description of Artificial Sequence: Synthetic peptide
  Seed: PDGGPCPSGSWSQKRSFVYVWKTW (PMEL_HUMAN)
  Core: RSFVYVWKT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSWSQKXSFXYXWKXW

SEQ ID NO: 333430 - protein, 25 aa, Artificial Sequence
  Description of Artificial Sequence: Synthetic peptide
  Seed: PDGGPCPSGSWSQKRSFVYVWKTWG (PMEL_HUMAN)
  Core: WSQKRSFVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSXSQXRXFVXVWKTWG

SEQ ID NO: 333431 - protein, 25 aa, Artificial Sequence
  Description of Artificial Sequence: Synthetic peptide
  Seed: PDGGPCPSGSWSQKRSFVYVWKTWG (PMEL_HUMAN)
  Core: RSFVYVWKT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PDGGPCPSGSWSQKXSFXYXWKXWG

SEQ ID NO: 333432 - protein, 13 aa, Artificial Sequence
  Description of Artificial Sequence: Synthetic peptide
  Seed: PDGQVIWVNNTII (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXI

SEQ ID NO: 333433 - protein, 13 aa, Artificial Sequence
  Description of Artificial Sequence: Synthetic peptide
  Seed: PDGQVIWVNNTII (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIX

SEQ ID NO: 333434 - protein, 14 aa, Artificial Sequence
  Description of Artificial Sequence: Synthetic peptide
  Seed: PDGQVIWVNNTIIN (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXIN

SEQ ID NO: 333435 - protein, 14 aa, Artificial Sequence
  Description of Artificial Sequence: Synthetic peptide
  Seed: PDGQVIWVNNTIIN (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXN

SEQ ID NO: 333436 - protein, 14 aa, Artificial Sequence
  Description of Artificial Sequence: Synthetic peptide
  Seed: PDGQVIWVNNTIIN (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIX

SEQ ID NO: 333437 - protein, 15 aa, Artificial Sequence
  Description of Artificial Sequence: Synthetic peptide
  Seed: PDGQVIWVNNTIING (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXING

SEQ ID NO: 333438 - protein, 15 aa, Artificial Sequence
  Description of Artificial Sequence: Synthetic peptide
  Seed: PDGQVIWVNNTIING (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNG

SEQ ID NO: 333439 - protein, 15 aa, Artificial Sequence
  Description of Artificial Sequence: Synthetic peptide
  Seed: PDGQVIWVNNTIING (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXG

SEQ ID NO: 333440 - protein, 16 aa, Artificial Sequence
  Description of Artificial Sequence: Synthetic peptide
  Seed: PDGQVIWVNNTIINGS (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGS

SEQ ID NO: 333441 - protein, 16 aa, Artificial Sequence
  Description of Artificial Sequence: Synthetic peptide
  Seed: PDGQVIWVNNTIINGS (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGS

SEQ ID NO: 333442 - protein, 16 aa, Artificial Sequence
  Description of Artificial Sequence: Synthetic peptide
  Seed: PDGQVIWVNNTIINGS (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGS

SEQ ID NO: 333443 - protein, 17 aa, Artificial Sequence
  Description of Artificial Sequence: Synthetic peptide
  Seed: PDGQVIWVNNTIINGSQ (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQ

SEQ ID NO: 333444 - protein, 17 aa, Artificial Sequence
  Description of Artificial Sequence: Synthetic peptide
  Seed: PDGQVIWVNNTIINGSQ (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQ

SEQ ID NO: 333445 - protein, 17 aa, Artificial Sequence
  Description of Artificial Sequence: Synthetic peptide
  Seed: PDGQVIWVNNTIINGSQ (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQ

SEQ ID NO: 333446 - protein, 17 aa, Artificial Sequence
  Description of Artificial Sequence: Synthetic peptide
  Seed: PDGQVIWVNNTIINGSQ (PMEL_HUMAN)
  Core: VNNTIINGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWXNNXIXNGXQ

SEQ ID NO: 333447 - protein, 18 aa, Artificial Sequence
  Description of Artificial Sequence: Synthetic peptide
  Seed: PDGQVIWVNNTIINGSQV (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQV

SEQ ID NO: 333448 - protein, 18 aa, Artificial Sequence
  Description of Artificial Sequence: Synthetic peptide
  Seed: PDGQVIWVNNTIINGSQV (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQV

SEQ ID NO: 333449 - protein, 18 aa, Artificial Sequence
  Description of Artificial Sequence: Synthetic peptide
  Seed: PDGQVIWVNNTIINGSQV (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQV

SEQ ID NO: 333450 - protein, 19 aa, Artificial Sequence
  Description of Artificial Sequence: Synthetic peptide
  Seed: PDGQVIWVNNTIINGSQVW (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQVW

SEQ ID NO: 333451 - protein, 19 aa, Artificial Sequence
  Description of Artificial Sequence: Synthetic peptide
  Seed: PDGQVIWVNNTIINGSQVW (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVW

SEQ ID NO: 333452 - protein, 19 aa, Artificial Sequence
  Description of Artificial Sequence: Synthetic peptide
  Seed: PDGQVIWVNNTIINGSQVW (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVW

SEQ ID NO: 333453 - protein, 19 aa, Artificial Sequence
  Description of Artificial Sequence: Synthetic peptide
  Seed: PDGQVIWVNNTIINGSQVW (PMEL_HUMAN)
  Core: VNNTIINGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWXNNXIXNGXQVW

SEQ ID NO: 333454 - protein, 20 aa, Artificial Sequence
  Description of Artificial Sequence: Synthetic peptide
  Seed: PDGQVIWVNNTIINGSQVWG (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQVWG

SEQ ID NO: 333455 - protein, 20 aa, Artificial Sequence
  Description of Artificial Sequence: Synthetic peptide
  Seed: PDGQVIWVNNTIINGSQVWG (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVWG

SEQ ID NO: 333456 - protein, 20 aa, Artificial Sequence
  Description of Artificial Sequence: Synthetic peptide
  Seed: PDGQVIWVNNTIINGSQVWG (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVWG

SEQ ID NO: 333457 - protein, 20 aa, Artificial Sequence
  Description of Artificial Sequence: Synthetic peptide
  Seed: PDGQVIWVNNTIINGSQVWG (PMEL_HUMAN)
  Core: WVNNTIING
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIXVNXTXINXSQVWG

SEQ ID NO: 333458 - protein, 20 aa, Artificial Sequence
  Description of Artificial Sequence: Synthetic peptide
  Seed: PDGQVIWVNNTIINGSQVWG (PMEL_HUMAN)
  Core: VNNTIINGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWXNNXIXNGXQVWG

SEQ ID NO: 333459 - protein, 21 aa, Artificial Sequence
  Description of Artificial Sequence: Synthetic peptide
  Seed: PDGQVIWVNNTIINGSQVWGG (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQVWGG

SEQ ID NO: 333460 - protein, 21 aa, Artificial Sequence
  Description of Artificial Sequence: Synthetic peptide
  Seed: PDGQVIWVNNTIINGSQVWGG (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVWGG

SEQ ID NO: 333461 - protein, 21 aa, Artificial Sequence
  Description of Artificial Sequence: Synthetic peptide
  Seed: PDGQVIWVNNTIINGSQVWGG (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVWGG

SEQ ID NO: 333462 - protein, 21 aa, Artificial Sequence
  Description of Artificial Sequence: Synthetic peptide
  Seed: PDGQVIWVNNTIINGSQVWGG (PMEL_HUMAN)
  Core: WVNNTIING
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIXVNXTXINXSQVWGG

SEQ ID NO: 333463 - protein, 21 aa, Artificial Sequence
  Description of Artificial Sequence: Synthetic peptide
  Seed: PDGQVIWVNNTIINGSQVWGG (PMEL_HUMAN)
  Core: INGSQVWGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWVNNTIXNGXQXWGX

SEQ ID NO: 333464 - protein, 22 aa, Artificial Sequence
  Description of Artificial Sequence: Synthetic peptide
  Seed: PDGQVIWVNNTIINGSQVWGGQ (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQVWGGQ

SEQ ID NO: 333465 - protein, 22 aa, Artificial Sequence
  Description of Artificial Sequence: Synthetic peptide
  Seed: PDGQVIWVNNTIINGSQVWGGQ (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVWGGQ

SEQ ID NO: 333466 - protein, 22 aa, Artificial Sequence
  Description of Artificial Sequence: Synthetic peptide
  Seed: PDGQVIWVNNTIINGSQVWGGQ (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVWGGQ

SEQ ID NO: 333467 - protein, 22 aa, Artificial Sequence
  Description of Artificial Sequence: Synthetic peptide
  Seed: PDGQVIWVNNTIINGSQVWGGQ (PMEL_HUMAN)
  Core: WVNNTIING
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIXVNXTXINXSQVWGGQ

SEQ ID NO: 333468 - protein, 22 aa, Artificial Sequence
  Description of Artificial Sequence: Synthetic peptide
  Seed: PDGQVIWVNNTIINGSQVWGGQ (PMEL_HUMAN)
  Core: INGSQVWGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWVNNTIXNGXQXWGXQ

SEQ ID NO: 333469 - protein, 23 aa, Artificial Sequence
  Description of Artificial Sequence: Synthetic peptide
  Seed: PDGQVIWVNNTIINGSQVWGGQP (PMEL_HUMAN)
  Core: QVIWVNNTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PDGXVIXVXNTXINGSQVWGGQP

SEQ ID NO: 333470 - protein, 23 aa, Artificial Sequence
  Description of Artificial Sequence: Synthetic peptide
  Seed: PDGQVIWVNNTIINGSQVWGGQP (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVWGGQP

SEQ ID NO: 333471 - protein, 23 aa, Artificial Sequence
  Description of Artificial Sequence: Synthetic peptide
  Seed: PDGQVIWVNNTIINGSQVWGGQP (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVWGGQP

SEQ ID NO: 333472 - protein, 23 aa, Artificial Sequence
  Description of Artificial Sequence: Synthetic peptide
  Seed: PDGQVIWVNNTIINGSQVWGGQP (PMEL_HUMAN)
  Core: WVNNTIING
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIXVNXTXINXSQVWGGQP

SEQ ID NO: 333473 - protein, 23 aa, Artificial Sequence
  Description of Artificial Sequence: Synthetic peptide
  Seed: PDGQVIWVNNTIINGSQVWGGQP (PMEL_HUMAN)
  Core: INGSQVWGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWVNNTIXNGXQXWGXQP

SEQ ID NO: 333474 - protein, 24 aa, Artificial Sequence
  Description of Artificial Sequence: Synthetic peptide
  Seed: PDGQVIWVNNTIINGSQVWGGQPV (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVWGGQPV

SEQ ID NO: 333475 - protein, 24 aa, Artificial Sequence
  Description of Artificial Sequence: Synthetic peptide
  Seed: PDGQVIWVNNTIINGSQVWGGQPV (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVWGGQPV

SEQ ID NO: 333476 - protein, 24 aa, Artificial Sequence
  Description of Artificial Sequence: Synthetic peptide
  Seed: PDGQVIWVNNTIINGSQVWGGQPV (PMEL_HUMAN)
  Core: WVNNTIING
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIXVNXTXINXSQVWGGQPV

SEQ ID NO: 333477 - protein, 24 aa, Artificial Sequence
  Description of Artificial Sequence: Synthetic peptide
  Seed: PDGQVIWVNNTIINGSQVWGGQPV (PMEL_HUMAN)
  Core: INGSQVWGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWVNNTIXNGXQXWGXQPV

SEQ ID NO: 333478 - protein, 25 aa, Artificial Sequence
  Description of Artificial Sequence: Synthetic peptide
  Seed: PDGQVIWVNNTIINGSQVWGGQPVY (PMEL_HUMAN)
  Core: VIWVNNTII
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PDGQXIWXNXTIXNGSQVWGGQPVY

SEQ ID NO: 333479 - protein, 25 aa, Artificial Sequence
  Description of Artificial Sequence: Synthetic peptide
  Seed: PDGQVIWVNNTIINGSQVWGGQPVY (PMEL_HUMAN)
  Core: IWVNNTIIN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVXWVXNXIIXGSQVWGGQPVY

SEQ ID NO: 333480 - protein, 25 aa, Artificial Sequence
  Description of Artificial Sequence: Synthetic peptide
  Seed: PDGQVIWVNNTIINGSQVWGGQPVY (PMEL_HUMAN)
  Core: WVNNTIING
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIXVNXTXINXSQVWGGQPVY

SEQ ID NO: 333481 - protein, 25 aa, Artificial Sequence
  Description of Artificial Sequence: Synthetic peptide
  Seed: PDGQVIWVNNTIINGSQVWGGQPVY (PMEL_HUMAN)
  Core: INGSQVWGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PDGQVIWVNNTIXNGXQXWGXQPVY

SEQ ID NO: 333482 - protein, 14 aa, Artificial Sequence
  Description of Artificial Sequence: Synthetic peptide
  Seed: PEATGMTPAEVSIV (PMEL_HUMAN)
  Core: ATGMTPAEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PEXTGXTXAEXSIV

SEQ ID NO: 333483 - protein, 14 aa, Artificial Sequence
  Description of Artificial Sequence: Synthetic peptide
  Seed: PEATGMTPAEVSIV (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIX

SEQ ID NO: 333484 - protein, 15 aa, Artificial Sequence
  Description of Artificial Sequence: Synthetic peptide
  Seed: PEATGMTPAEVSIVV (PMEL_HUMAN)
  Core: ATGMTPAEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PEXTGXTXAEXSIVV

SEQ ID NO: 333485 - protein, 15 aa, Artificial Sequence
  Description of Artificial Sequence: Synthetic peptide
  Seed: PEATGMTPAEVSIVV (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXV

SEQ ID NO: 333486 - protein, 16 aa, Artificial Sequence
  Description of Artificial Sequence: Synthetic peptide
  Seed: PEATGMTPAEVSIVVL (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVL

SEQ ID NO: 333487 - protein, 17 aa, Artificial Sequence
  Description of Artificial Sequence: Synthetic peptide
  Seed: PEATGMTPAEVSIVVLS (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLS

SEQ ID NO: 333488 - protein, 18 aa, Artificial Sequence
  Description of Artificial Sequence: Synthetic peptide
  Seed: PEATGMTPAEVSIVVLSG (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSG

SEQ ID NO: 333489 - protein, 19 aa, Artificial Sequence
  Description of Artificial Sequence: Synthetic peptide
  Seed: PEATGMTPAEVSIVVLSGT (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGT

SEQ ID NO: 333490 - protein, 20 aa, Artificial Sequence
  Description of Artificial Sequence: Synthetic peptide
  Seed: PEATGMTPAEVSIVVLSGTT (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGTT

SEQ ID NO: 333491 - protein, 20 aa, Artificial Sequence
  Description of Artificial Sequence: Synthetic peptide
  Seed: PEATGMTPAEVSIVVLSGTT (PMEL_HUMAN)
  Core: EVSIVVLSG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAXVSXVXLSXTT

SEQ ID NO: 333492 - protein, 21 aa, Artificial Sequence
  Description of Artificial Sequence: Synthetic peptide
  Seed: PEATGMTPAEVSIVVLSGTTA (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGTTA

SEQ ID NO: 333493 - protein, 21 aa, Artificial Sequence
  Description of Artificial Sequence: Synthetic peptide
  Seed: PEATGMTPAEVSIVVLSGTTA (PMEL_HUMAN)
  Core: EVSIVVLSG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAXVSXVXLSXTTA

SEQ ID NO: 333494 - protein, 21 aa, Artificial Sequence
  Description of Artificial Sequence: Synthetic peptide
  Seed: PEATGMTPAEVSIVVLSGTTA (PMEL_HUMAN)
  Core: IVVLSGTTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSXVVXSXTTX

SEQ ID NO: 333495 - protein, 22 aa, Artificial Sequence
  Description of Artificial Sequence: Synthetic peptide
  Seed: PEATGMTPAEVSIVVLSGTTAA (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGTTAA

SEQ ID NO: 333496 - protein, 22 aa, Artificial Sequence
  Description of Artificial Sequence: Synthetic peptide
  Seed: PEATGMTPAEVSIVVLSGTTAA (PMEL_HUMAN)
  Core: EVSIVVLSG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAXVSXVXLSXTTAA

SEQ ID NO: 333497 - protein, 22 aa, Artificial Sequence
  Description of Artificial Sequence: Synthetic peptide
  Seed: PEATGMTPAEVSIVVLSGTTAA (PMEL_HUMAN)
  Core: IVVLSGTTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSXVVXSXTTXA

SEQ ID NO: 333498 - protein, 23 aa, Artificial Sequence
  Description of Artificial Sequence: Synthetic peptide
  Seed: PEATGMTPAEVSIVVLSGTTAAQ (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGTTAAQ

SEQ ID NO: 333499 - protein, 23 aa, Artificial Sequence
  Description of Artificial Sequence: Synthetic peptide
  Seed: PEATGMTPAEVSIVVLSGTTAAQ (PMEL_HUMAN)
  Core: EVSIVVLSG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAXVSXVXLSXTTAAQ

SEQ ID NO: 333500 - protein, 23 aa, Artificial Sequence
  Description of Artificial Sequence: Synthetic peptide
  Seed: PEATGMTPAEVSIVVLSGTTAAQ (PMEL_HUMAN)
  Core: IVVLSGTTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSXVVXSXTTXAQ

SEQ ID NO: 333501 - protein, 24 aa, Artificial Sequence
  Description of Artificial Sequence: Synthetic peptide
  Seed: PEATGMTPAEVSIVVLSGTTAAQV (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGTTAAQV

SEQ ID NO: 333502 - protein, 24 aa, Artificial Sequence
  Description of Artificial Sequence: Synthetic peptide
  Seed: PEATGMTPAEVSIVVLSGTTAAQV (PMEL_HUMAN)
  Core: EVSIVVLSG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAXVSXVXLSXTTAAQV

SEQ ID NO: 333503 - protein, 24 aa, Artificial Sequence
  Description of Artificial Sequence: Synthetic peptide
  Seed: PEATGMTPAEVSIVVLSGTTAAQV (PMEL_HUMAN)
  Core: IVVLSGTTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSXVVXSXTTXAQV

SEQ ID NO: 333504 - protein, 24 aa, Artificial Sequence
  Description of Artificial Sequence: Synthetic peptide
  Seed: PEATGMTPAEVSIVVLSGTTAAQV (PMEL_HUMAN)
  Core: VLSGTTAAQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSIVXLSXTXAAXV

SEQ ID NO: 333505 - protein, 24 aa, Artificial Sequence
  Description of Artificial Sequence: Synthetic peptide
  Seed: PEATGMTPAEVSIVVLSGTTAAQV (PMEL_HUMAN)
  Core: LSGTTAAQV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSIVVXSGXTXAQX

SEQ ID NO: 333506 - protein, 25 aa, Artificial Sequence
  Description of Artificial Sequence: Synthetic peptide
  Seed: PEATGMTPAEVSIVVLSGTTAAQVT (PMEL_HUMAN)
  Core: MTPAEVSIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEATGXTPXEXSIXVLSGTTAAQVT

SEQ ID NO: 333507 - protein, 25 aa, Artificial Sequence
  Description of Artificial Sequence: Synthetic peptide
  Seed: PEATGMTPAEVSIVVLSGTTAAQVT (PMEL_HUMAN)
  Core: EVSIVVLSG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAXVSXVXLSXTTAAQVT

SEQ ID NO: 333508 - protein, 25 aa, Artificial Sequence
  Description of Artificial Sequence: Synthetic peptide
  Seed: PEATGMTPAEVSIVVLSGTTAAQVT (PMEL_HUMAN)
  Core: VSIVVLSGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEXSIXVXSGXTAAQVT

SEQ ID NO: 333509 - protein, 25 aa, Artificial Sequence
  Description of Artificial Sequence: Synthetic peptide
  Seed: PEATGMTPAEVSIVVLSGTTAAQVT (PMEL_HUMAN)
  Core: IVVLSGTTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSXVVXSXTTXAQVT

SEQ ID NO: 333510 - protein, 25 aa, Artificial Sequence
  Description of Artificial Sequence: Synthetic peptide
  Seed: PEATGMTPAEVSIVVLSGTTAAQVT (PMEL_HUMAN)
  Core: VVLSGTTAA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSIXVLXGXTAXQVT

SEQ ID NO: 333511 - protein, 25 aa, Artificial Sequence
  Description of Artificial Sequence: Synthetic peptide
  Seed: PEATGMTPAEVSIVVLSGTTAAQVT (PMEL_HUMAN)
  Core: VLSGTTAAQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSIVXLSXTXAAXVT

SEQ ID NO: 333512 - protein, 25 aa, Artificial Sequence
  Description of Artificial Sequence: Synthetic peptide
  Seed: PEATGMTPAEVSIVVLSGTTAAQVT (PMEL_HUMAN)
  Core: LSGTTAAQV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PEATGMTPAEVSIVVXSGXTXAQXT

SEQ ID NO: 333513 - protein, 13 aa, Artificial Sequence
  Description of Artificial Sequence: Synthetic peptide
  Seed: PEGPDASSIMSTE (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXE

SEQ ID NO: 333514 - protein, 14 aa, Artificial Sequence
  Description of Artificial Sequence: Synthetic peptide
  Seed: PEGPDASSIMSTES (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXES

SEQ ID NO: 333515 - protein, 15 aa, Artificial Sequence
  Description of Artificial Sequence: Synthetic peptide
  Seed: PEGPDASSIMSTESI (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESI

SEQ ID NO: 333516 - protein, 16 aa, Artificial Sequence
  Description of Artificial Sequence: Synthetic peptide
  Seed: PEGPDASSIMSTESIT (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESIT

SEQ ID NO: 333517 - protein, 17 aa, Artificial Sequence
  Description of Artificial Sequence: Synthetic peptide
  Seed: PEGPDASSIMSTESITG (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITG

SEQ ID NO: 333518 - protein, 17 aa, Artificial Sequence
  Description of Artificial Sequence: Synthetic peptide
  Seed: PEGPDASSIMSTESITG (PMEL_HUMAN)
  Core: ASSIMSTES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDXSSXMXTEXITG

SEQ ID NO: 333519 - protein, 18 aa, Artificial Sequence
  Description of Artificial Sequence: Synthetic peptide
  Seed: PEGPDASSIMSTESITGS (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGS

SEQ ID NO: 333520 - protein, 19 aa, Artificial Sequence
  Description of Artificial Sequence: Synthetic peptide
  Seed: PEGPDASSIMSTESITGSL (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSL

SEQ ID NO: 333521 - protein, 20 aa, Artificial Sequence
  Description of Artificial Sequence: Synthetic peptide
  Seed: PEGPDASSIMSTESITGSLG (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSLG

SEQ ID NO: 333522 - protein, 20 aa, Artificial Sequence
  Description of Artificial Sequence: Synthetic peptide
  Seed: PEGPDASSIMSTESITGSLG (PMEL_HUMAN)
  Core: IMSTESITG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSXMSXEXITXSLG

SEQ ID NO: 333523 - protein, 21 aa, Artificial Sequence
  Description of Artificial Sequence: Synthetic peptide
  Seed: PEGPDASSIMSTESITGSLGP (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSLGP

SEQ ID NO: 333524 - protein, 22 aa, Artificial Sequence
  Description of Artificial Sequence: Synthetic peptide
  Seed: PEGPDASSIMSTESITGSLGPL (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSLGPL

SEQ ID NO: 333525 - protein, 23 aa, Artificial Sequence
  Description of Artificial Sequence: Synthetic peptide
  Seed: PEGPDASSIMSTESITGSLGPLL (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSLGPLL

SEQ ID NO: 333526 - protein, 23 aa, Artificial Sequence
  Description of Artificial Sequence: Synthetic peptide
  Seed: PEGPDASSIMSTESITGSLGPLL (PMEL_HUMAN)
  Core: IMSTESITG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSXMSXEXITXSLGPLL

SEQ ID NO: 333527 - protein, 24 aa, Artificial Sequence
  Description of Artificial Sequence: Synthetic peptide
  Seed: PEGPDASSIMSTESITGSLGPLLD (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSLGPLLD

SEQ ID NO: 333528 - protein, 24 aa, Artificial Sequence
  Description of Artificial Sequence: Synthetic peptide
  Seed: PEGPDASSIMSTESITGSLGPLLD (PMEL_HUMAN)
  Core: IMSTESITG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSXMSXEXITXSLGPLLD

SEQ ID NO: 333529 - protein, 24 aa, Artificial Sequence
  Description of Artificial Sequence: Synthetic peptide
  Seed: PEGPDASSIMSTESITGSLGPLLD (PMEL_HUMAN)
  Core: ITGSLGPLL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSIMSTESXTGXLXPLXD

SEQ ID NO: 333530 - protein, 25 aa, Artificial Sequence
  Description of Artificial Sequence: Synthetic peptide
  Seed: PEGPDASSIMSTESITGSLGPLLDG (PMEL_HUMAN)
  Core: PDASSIMST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEGXDAXSXMSXESITGSLGPLLDG

SEQ ID NO: 333531 - protein, 25 aa, Artificial Sequence
  Description of Artificial Sequence: Synthetic peptide
  Seed: PEGPDASSIMSTESITGSLGPLLDG (PMEL_HUMAN)
  Core: IMSTESITG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSXMSXEXITXSLGPLLDG

SEQ ID NO: 333532 - protein, 25 aa, Artificial Sequence
  Description of Artificial Sequence: Synthetic peptide
  Seed: PEGPDASSIMSTESITGSLGPLLDG (PMEL_HUMAN)
  Core: SITGSLGPL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSIMSTEXITXSXGPXLDG

SEQ ID NO: 333533 - protein, 25 aa, Artificial Sequence
  Description of Artificial Sequence: Synthetic peptide
  Seed: PEGPDASSIMSTESITGSLGPLLDG (PMEL_HUMAN)
  Core: ITGSLGPLL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PEGPDASSIMSTESXTGXLXPLXDG

SEQ ID NO: 333534 - protein, 15 aa, Artificial Sequence
  Description of Artificial Sequence: Synthetic peptide
  Seed: PEKVPVSEVMGTTLA (PMEL_HUMAN)
  Core: VPVSEVMGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEKXPVXEXMGXTLA

SEQ ID NO: 333535 - protein, 15 aa, Artificial Sequence
  Description of Artificial Sequence: Synthetic peptide
  Seed: PEKVPVSEVMGTTLA (PMEL_HUMAN)
  Core: VSEVMGTTL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPXSEXMXTTXA

SEQ ID NO: 333536 - protein, 16 aa, Artificial Sequence
  Description of Artificial Sequence: Synthetic peptide
  Seed: PEKVPVSEVMGTTLAE (PMEL_HUMAN)
  Core: VPVSEVMGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEKXPVXEXMGXTLAE

SEQ ID NO: 333537 - protein, 17 aa, Artificial Sequence
  Description of Artificial Sequence: Synthetic peptide
  Seed: PEKVPVSEVMGTTLAEM (PMEL_HUMAN)
  Core: VPVSEVMGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PEKXPVXEXMGXTLAEM

SEQ ID NO: 333538 - protein, 17 aa, Artificial Sequence
  Description of Artificial Sequence: Synthetic peptide
  Seed: PEKVPVSEVMGTTLAEM (PMEL_HUMAN)
  Core: PVSEVMGTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PEKVXVSXVXGTXLAEM

SEQ ID NO: 333539 - protein, 17 aa, Artificial Sequence
  Description of Artificial Sequence: Synthetic peptide
  Seed: PEKVPVSEVMGTTLAEM (PMEL_HUMAN)
  Core: VSEVMGTTL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPXSEXMXTTXAEM

SEQ ID NO: 333540 - protein, 17 aa, Artificial Sequence
  Description of Artificial Sequence: Synthetic peptide
  Seed: PEKVPVSEVMGTTLAEM (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEX

SEQ ID NO: 333541 - protein, 18 aa, Artificial Sequence
  Description of Artificial Sequence: Synthetic peptide
  Seed: PEKVPVSEVMGTTLAEMS (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXS

SEQ ID NO: 333542 - protein, 19 aa, Artificial Sequence
  Description of Artificial Sequence: Synthetic peptide
  Seed: PEKVPVSEVMGTTLAEMST (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXST

SEQ ID NO: 333543 - protein, 19 aa, Artificial Sequence
  Description of Artificial Sequence: Synthetic peptide
  Seed: PEKVPVSEVMGTTLAEMST (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXT

SEQ ID NO: 333544 - protein, 20 aa, Artificial Sequence
  Description of Artificial Sequence: Synthetic peptide
  Seed: PEKVPVSEVMGTTLAEMSTP (PMEL_HUMAN)
  Core: VSEVMGTTL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPXSEXMXTTXAEMSTP

SEQ ID NO: 333545 - protein, 20 aa, Artificial Sequence
  Description of Artificial Sequence: Synthetic peptide
  Seed: PEKVPVSEVMGTTLAEMSTP (PMEL_HUMAN)
  Core: EVMGTTLAE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSXVMXTXLAXMSTP

SEQ ID NO: 333546 - protein, 20 aa, Artificial Sequence
  Description of Artificial Sequence: Synthetic peptide
  Seed: PEKVPVSEVMGTTLAEMSTP (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXSTP

SEQ ID NO: 333547 - protein, 20 aa, Artificial Sequence
  Description of Artificial Sequence: Synthetic peptide
  Seed: PEKVPVSEVMGTTLAEMSTP (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXTP

SEQ ID NO: 333548 - protein, 21 aa, Artificial Sequence
  Description of Artificial Sequence: Synthetic peptide
  Seed: PEKVPVSEVMGTTLAEMSTPE (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXSTPE

SEQ ID NO: 333549 - protein, 21 aa, Artificial Sequence
  Description of Artificial Sequence: Synthetic peptide
  Seed: PEKVPVSEVMGTTLAEMSTPE (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXTPE

SEQ ID NO: 333550 - protein, 22 aa, Artificial Sequence
  Description of Artificial Sequence: Synthetic peptide
  Seed: PEKVPVSEVMGTTLAEMSTPEA (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXSTPEA

SEQ ID NO: 333551 - protein, 22 aa, Artificial Sequence
  Description of Artificial Sequence: Synthetic peptide
  Seed: PEKVPVSEVMGTTLAEMSTPEA (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXTPEA

SEQ ID NO: 333552 - protein, 23 aa, Artificial Sequence
  Description of Artificial Sequence: Synthetic peptide
  Seed: PEKVPVSEVMGTTLAEMSTPEAT (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXSTPEAT

SEQ ID NO: 333553 - protein, 23 aa, Artificial Sequence
  Description of Artificial Sequence: Synthetic peptide
  Seed: PEKVPVSEVMGTTLAEMSTPEAT (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXTPEAT

SEQ ID NO: 333554 - protein, 23 aa, Artificial Sequence
  Description of Artificial Sequence: Synthetic peptide
  Seed: PEKVPVSEVMGTTLAEMSTPEAT (PMEL_HUMAN)
  Core: LAEMSTPEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVMGTTXAEXSXPEXT

SEQ ID NO: 333555 - protein, 24 aa, Artificial Sequence
  Description of Artificial Sequence: Synthetic peptide
  Seed: PEKVPVSEVMGTTLAEMSTPEATG (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXSTPEATG

SEQ ID NO: 333556 - protein, 24 aa, Artificial Sequence
  Description of Artificial Sequence: Synthetic peptide
  Seed: PEKVPVSEVMGTTLAEMSTPEATG (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXTPEATG

SEQ ID NO: 333557 - protein, 24 aa, Artificial Sequence
  Description of Artificial Sequence: Synthetic peptide
  Seed: PEKVPVSEVMGTTLAEMSTPEATG (PMEL_HUMAN)
  Core: LAEMSTPEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVMGTTXAEXSXPEXTG

SEQ ID NO: 333558 - protein, 25 aa, Artificial Sequence
  Description of Artificial Sequence: Synthetic peptide
  Seed: PEKVPVSEVMGTTLAEMSTPEATGM (PMEL_HUMAN)
  Core: VMGTTLAEM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEXMGXTXAEXSTPEATGM

SEQ ID NO: 333559 - protein, 25 aa, Artificial Sequence
  Description of Artificial Sequence: Synthetic peptide
  Seed: PEKVPVSEVMGTTLAEMSTPEATGM (PMEL_HUMAN)
  Core: MGTTLAEMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVXGTXLXEMXTPEATGM

SEQ ID NO: 333560 - protein, 25 aa, Artificial Sequence
  Description of Artificial Sequence: Synthetic peptide
  Seed: PEKVPVSEVMGTTLAEMSTPEATGM (PMEL_HUMAN)
  Core: LAEMSTPEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PEKVPVSEVMGTTXAEXSXPEXTGM

SEQ ID NO: 333561 - protein, 14 aa, Artificial Sequence
  Description of Artificial Sequence: Synthetic peptide
  Seed: PEPEGPDASSIMST (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSX

SEQ ID NO: 333562 - protein, 15 aa, Artificial Sequence
  Description of Artificial Sequence: Synthetic peptide
  Seed: PEPEGPDASSIMSTE (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXE

SEQ ID NO: 333563 - protein, 16 aa, Artificial Sequence
  Description of Artificial Sequence: Synthetic peptide
  Seed: PEPEGPDASSIMSTES (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXES

SEQ ID NO: 333564 - protein, 17 aa, Artificial Sequence
  Description of Artificial Sequence: Synthetic peptide
  Seed: PEPEGPDASSIMSTESI (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESI

SEQ ID NO: 333565 - protein, 18 aa, Artificial Sequence
  Description of Artificial Sequence: Synthetic peptide
  Seed: PEPEGPDASSIMSTESIT (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESIT

SEQ ID NO: 333566 - protein, 19 aa, Artificial Sequence
  Description of Artificial Sequence: Synthetic peptide
  Seed: PEPEGPDASSIMSTESITG (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITG

SEQ ID NO: 333567 - protein, 20 aa, Artificial Sequence
  Description of Artificial Sequence: Synthetic peptide
  Seed: PEPEGPDASSIMSTESITGS (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITGS

SEQ ID NO: 333568 - protein, 21 aa, Artificial Sequence
  Description of Artificial Sequence: Synthetic peptide
  Seed: PEPEGPDASSIMSTESITGSL (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITGSL

SEQ ID NO: 333569 - protein, 22 aa, Artificial Sequence
  Description of Artificial Sequence: Synthetic peptide
  Seed: PEPEGPDASSIMSTESITGSLG (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITGSLG

SEQ ID NO: 333570 - protein, 23 aa, Artificial Sequence
  Description of Artificial Sequence: Synthetic peptide
  Seed: PEPEGPDASSIMSTESITGSLGP (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITGSLGP

SEQ ID NO: 333571 - protein, 24 aa, Artificial Sequence
  Description of Artificial Sequence: Synthetic peptide
  Seed: PEPEGPDASSIMSTESITGSLGPL (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITGSLGPL

SEQ ID NO: 333572 - protein, 25 aa, Artificial Sequence
  Description of Artificial Sequence: Synthetic peptide
  Seed: PEPEGPDASSIMSTESITGSLGPLL (PMEL_HUMAN)
  Core: PDASSIMST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGXDAXSXMSXESITGSLGPLL

SEQ ID NO: 333573 - protein, 25 aa, Artificial Sequence
  Description of Artificial Sequence: Synthetic peptide
  Seed: PEPEGPDASSIMSTESITGSLGPLL (PMEL_HUMAN)
  Core: IMSTESITG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PEPEGPDASSXMSXEXITXSLGPLL

SEQ ID NO: 333574 - protein, 22 aa, Artificial Sequence
  Description of Artificial Sequence: Synthetic peptide
  Seed: PEWTEAQRLDCWRGGQVSLKVS (PMEL_HUMAN)
  Core: WRGGQVSLK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PEWTEAQRLDCXRGXQXSLXVS

SEQ ID NO: 333575 - protein, 23 aa, Artificial Sequence
  Description of Artificial Sequence: Synthetic peptide
  Seed: PEWTEAQRLDCWRGGQVSLKVSN (PMEL_HUMAN)
  Core: WRGGQVSLK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PEWTEAQRLDCXRGXQXSLXVSN

SEQ ID NO: 333576 - protein, 24 aa, Artificial Sequence
  Description of Artificial Sequence: Synthetic peptide
  Seed: PEWTEAQRLDCWRGGQVSLKVSND (PMEL_HUMAN)
  Core: WRGGQVSLK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PEWTEAQRLDCXRGXQXSLXVSND

SEQ ID NO: 333577 - protein, 25 aa, Artificial Sequence
  Description of Artificial Sequence: Synthetic peptide
  Seed: PEWTEAQRLDCWRGGQVSLKVSNDG (PMEL_HUMAN)
  Core: WRGGQVSLK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PEWTEAQRLDCXRGXQXSLXVSNDG

SEQ ID NO: 333578 - protein, 13 aa, Artificial Sequence
  Description of Artificial Sequence: Synthetic peptide
  Seed: PFSVSVSQLRALD (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXD

SEQ ID NO: 333579 - protein, 14 aa, Artificial Sequence
  Description of Artificial Sequence: Synthetic peptide
  Seed: PFSVSVSQLRALDG (PMEL_HUMAN)
  Core: FSVSVSQLR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSVXVXQLXALDG

SEQ ID NO: 333580 - protein, 14 aa, Artificial Sequence
  Description of Artificial Sequence: Synthetic peptide
  Seed: PFSVSVSQLRALDG (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDG

SEQ ID NO: 333581 - protein, 14 aa, Artificial Sequence
  Description of Artificial Sequence: Synthetic peptide
  Seed: PFSVSVSQLRALDG (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDX

SEQ ID NO: 333582 - protein, 15 aa, Artificial Sequence
  Description of Artificial Sequence: Synthetic peptide
  Seed: PFSVSVSQLRALDGG (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGG

SEQ ID NO: 333583 - protein, 15 aa, Artificial Sequence
  Description of Artificial Sequence: Synthetic peptide
  Seed: PFSVSVSQLRALDGG (PMEL_HUMAN)
  Core: SVSQLRALD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PFSVXVSXLXALXGG

SEQ ID NO: 333584 - protein, 15 aa, Artificial Sequence
  Description of Artificial Sequence: Synthetic peptide
  Seed: PFSVSVSQLRALDGG (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXG

SEQ ID NO: 333585 - protein, 16 aa, Artificial Sequence
  Description of Artificial Sequence: Synthetic peptide
  Seed: PFSVSVSQLRALDGGN (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGN

SEQ ID NO: 333586 - protein, 16 aa, Artificial Sequence
  Description of Artificial Sequence: Synthetic peptide
  Seed: PFSVSVSQLRALDGGN (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGN

SEQ ID NO: 333587 - protein, 17 aa, Artificial Sequence
  Description of Artificial Sequence: Synthetic peptide
  Seed: PFSVSVSQLRALDGGNK (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNK

SEQ ID NO: 333588 - protein, 17 aa, Artificial Sequence
  Description of Artificial Sequence: Synthetic peptide
  Seed: PFSVSVSQLRALDGGNK (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNK

SEQ ID NO: 333589 - protein, 19 aa, Artificial Sequence
  Description of Artificial Sequence: Synthetic peptide
  Seed: PFSVSVSQLRALDGGNKHF (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHF

SEQ ID NO: 333590 - protein, 19 aa, Artificial Sequence
  Description of Artificial Sequence: Synthetic peptide
  Seed: PFSVSVSQLRALDGGNKHF (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHF

SEQ ID NO: 333591 - protein, 20 aa, Artificial Sequence
  Description of Artificial Sequence: Synthetic peptide
  Seed: PFSVSVSQLRALDGGNKHFL (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHFL

SEQ ID NO: 333592 - protein, 20 aa, Artificial Sequence
  Description of Artificial Sequence: Synthetic peptide
  Seed: PFSVSVSQLRALDGGNKHFL (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHFL

SEQ ID NO: 333593 - protein, 20 aa, Artificial Sequence
  Description of Artificial Sequence: Synthetic peptide
  Seed: PFSVSVSQLRALDGGNKHFL (PMEL_HUMAN)
  Core: LRALDGGNK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQXRAXDXGNXHFL

SEQ ID NO: 333594 - protein, 20 aa, Artificial Sequence
  Description of Artificial Sequence: Synthetic peptide
  Seed: PFSVSVSQLRALDGGNKHFL (PMEL_HUMAN)
  Core: RALDGGNKH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLXALXGXNKXFL

SEQ ID NO: 333595 - protein, 21 aa, Artificial Sequence
  Description of Artificial Sequence: Synthetic peptide
  Seed: PFSVSVSQLRALDGGNKHFLR (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHFLR

SEQ ID NO: 333596 - protein, 21 aa, Artificial Sequence
  Description of Artificial Sequence: Synthetic peptide
  Seed: PFSVSVSQLRALDGGNKHFLR (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHFLR

SEQ ID NO: 333597 - protein, 21 aa, Artificial Sequence
  Description of Artificial Sequence: Synthetic peptide
  Seed: PFSVSVSQLRALDGGNKHFLR (PMEL_HUMAN)
  Core: LRALDGGNK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQXRAXDXGNXHFLR

SEQ ID NO: 333598 - protein, 21 aa, Artificial Sequence
  Description of Artificial Sequence: Synthetic peptide
  Seed: PFSVSVSQLRALDGGNKHFLR (PMEL_HUMAN)
  Core: RALDGGNKH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLXALXGXNKXFLR

SEQ ID NO: 333599 - protein, 22 aa, Artificial Sequence
  Description of Artificial Sequence: Synthetic peptide
  Seed: PFSVSVSQLRALDGGNKHFLRN (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHFLRN

SEQ ID NO: 333600 - protein, 22 aa, Artificial Sequence
  Description of Artificial Sequence: Synthetic peptide
  Seed: PFSVSVSQLRALDGGNKHFLRN (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHFLRN

SEQ ID NO: 333601 - protein, 22 aa, Artificial Sequence
  Description of Artificial Sequence: Synthetic peptide
  Seed: PFSVSVSQLRALDGGNKHFLRN (PMEL_HUMAN)
  Core: LRALDGGNK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQXRAXDXGNXHFLRN

SEQ ID NO: 333602 - protein, 22 aa, Artificial Sequence
  Description of Artificial Sequence: Synthetic peptide
  Seed: PFSVSVSQLRALDGGNKHFLRN (PMEL_HUMAN)
  Core: RALDGGNKH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLXALXGXNKXFLRN

SEQ ID NO: 333603 - protein, 23 aa, Artificial Sequence
  Description of Artificial Sequence: Synthetic peptide
  Seed: PFSVSVSQLRALDGGNKHFLRNQ (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHFLRNQ

SEQ ID NO: 333604 - protein, 23 aa, Artificial Sequence
  Description of Artificial Sequence: Synthetic peptide
  Seed: PFSVSVSQLRALDGGNKHFLRNQ (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHFLRNQ

SEQ ID NO: 333605 - protein, 23 aa, Artificial Sequence
  Description of Artificial Sequence: Synthetic peptide
  Seed: PFSVSVSQLRALDGGNKHFLRNQ (PMEL_HUMAN)
  Core: LRALDGGNK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQXRAXDXGNXHFLRNQ

SEQ ID NO: 333606 - protein, 23 aa, Artificial Sequence
  Description of Artificial Sequence: Synthetic peptide
  Seed: PFSVSVSQLRALDGGNKHFLRNQ (PMEL_HUMAN)
  Core: RALDGGNKH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLXALXGXNKXFLRNQ

SEQ ID NO: 333607 - protein, 23 aa, Artificial Sequence
  Description of Artificial Sequence: Synthetic peptide
  Seed: PFSVSVSQLRALDGGNKHFLRNQ (PMEL_HUMAN)
  Core: LDGGNKHFL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLRAXDGXNXHFXRNQ

SEQ ID NO: 333608 - protein, 24 aa, Artificial Sequence
  Description of Artificial Sequence: Synthetic peptide
  Seed: PFSVSVSQLRALDGGNKHFLRNQP (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHFLRNQP

SEQ ID NO: 333609 - protein, 24 aa, Artificial Sequence
  Description of Artificial Sequence: Synthetic peptide
  Seed: PFSVSVSQLRALDGGNKHFLRNQP (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHFLRNQP

SEQ ID NO: 333610 - protein, 24 aa, Artificial Sequence
  Description of Artificial Sequence: Synthetic peptide
  Seed: PFSVSVSQLRALDGGNKHFLRNQP (PMEL_HUMAN)
  Core: LRALDGGNK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQXRAXDXGNXHFLRNQP

SEQ ID NO: 333611 - protein, 24 aa, Artificial Sequence
  Description of Artificial Sequence: Synthetic peptide
  Seed: PFSVSVSQLRALDGGNKHFLRNQP (PMEL_HUMAN)
  Core: RALDGGNKH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLXALXGXNKXFLRNQP

SEQ ID NO: 333612 - protein, 24 aa, Artificial Sequence
  Description of Artificial Sequence: Synthetic peptide
  Seed: PFSVSVSQLRALDGGNKHFLRNQP (PMEL_HUMAN)
  Core: LDGGNKHFL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLRAXDGXNXHFXRNQP

SEQ ID NO: 333613 - protein, 25 aa, Artificial Sequence
  Description of Artificial Sequence: Synthetic peptide
  Seed: PFSVSVSQLRALDGGNKHFLRNQPL (PMEL_HUMAN)
  Core: VSVSQLRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PFSXSVXQXRAXDGGNKHFLRNQPL

SEQ ID NO: 333614 - protein, 25 aa, Artificial Sequence
  Description of Artificial Sequence: Synthetic peptide
  Seed: PFSVSVSQLRALDGGNKHFLRNQPL (PMEL_HUMAN)
  Core: VSQLRALDG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSXSQXRXLDXGNKHFLRNQPL

SEQ ID NO: 333615 - protein, 25 aa, Artificial Sequence
  Description of Artificial Sequence: Synthetic peptide
  Seed: PFSVSVSQLRALDGGNKHFLRNQPL (PMEL_HUMAN)
  Core: LRALDGGNK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQXRAXDXGNXHFLRNQPL

SEQ ID NO: 333616 - protein, 25 aa, Artificial Sequence
  Description of Artificial Sequence: Synthetic peptide
  Seed: PFSVSVSQLRALDGGNKHFLRNQPL (PMEL_HUMAN)
  Core: RALDGGNKH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLXALXGXNKXFLRNQPL

SEQ ID NO: 333617 - protein, 25 aa, Artificial Sequence
  Description of Artificial Sequence: Synthetic peptide
  Seed: PFSVSVSQLRALDGGNKHFLRNQPL (PMEL_HUMAN)
  Core: LDGGNKHFL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PFSVSVSQLRAXDGXNXHFXRNQPL

SEQ ID NO: 333618 - protein, 23 aa, Artificial Sequence
  Description of Artificial Sequence: Synthetic peptide
  Seed: PGCQPPAQRLCQPVLPSPACQLV (PMEL_HUMAN)
  Core: QRLCQPVLP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGCQPPAXRLXQXVLXSPACQLV

SEQ ID NO: 333619 - protein, 24 aa, Artificial Sequence
  Description of Artificial Sequence: Synthetic peptide
  Seed: PGCQPPAQRLCQPVLPSPACQLVL (PMEL_HUMAN)
  Core: QRLCQPVLP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGCQPPAXRLXQXVLXSPACQLVL

SEQ ID NO: 333620 - protein, 24 aa, Artificial Sequence
  Description of Artificial Sequence: Synthetic peptide
  Seed: PGCQPPAQRLCQPVLPSPACQLVL (PMEL_HUMAN)
  Core: VLPSPACQL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PGCQPPAQRLCQPXLPXPXCQXVL

SEQ ID NO: 333621 - protein, 25 aa, Artificial Sequence
  Description of Artificial Sequence: Synthetic peptide
  Seed: PGCQPPAQRLCQPVLPSPACQLVLH (PMEL_HUMAN)
  Core: QRLCQPVLP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGCQPPAXRLXQXVLXSPACQLVLH

SEQ ID NO: 333622 - protein, 25 aa, Artificial Sequence
  Description of Artificial Sequence: Synthetic peptide
  Seed: PGCQPPAQRLCQPVLPSPACQLVLH (PMEL_HUMAN)
  Core: RLCQPVLPS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGCQPPAQXLCXPXLPXPACQLVLH

SEQ ID NO: 333623 - protein, 25 aa, Artificial Sequence
  Description of Artificial Sequence: Synthetic peptide
  Seed: PGCQPPAQRLCQPVLPSPACQLVLH (PMEL_HUMAN)
  Core: VLPSPACQL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PGCQPPAQRLCQPXLPXPXCQXVLH

SEQ ID NO: 333624 - protein, 13 aa, Artificial Sequence
  Description of Artificial Sequence: Synthetic peptide
  Seed: PGPVTAQVVLQAA (PMEL_HUMAN)
  Core: PVTAQVVLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PGXVTXQXVLXAA

SEQ ID NO: 333625 - protein, 13 aa, Artificial Sequence
  Description of Artificial Sequence: Synthetic peptide
  Seed: PGPVTAQVVLQAA (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAX

SEQ ID NO: 333626 - protein, 14 aa, Artificial Sequence
  Description of Artificial Sequence: Synthetic peptide
  Seed: PGPVTAQVVLQAAI (PMEL_HUMAN)
  Core: PVTAQVVLQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PGXVTXQXVLXAAI

SEQ ID NO: 333627 - protein, 14 aa, Artificial Sequence
  Description of Artificial Sequence: Synthetic peptide
  Seed: PGPVTAQVVLQAAI (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAI

SEQ ID NO: 333628 - protein, 14 aa, Artificial Sequence
  Description of Artificial Sequence: Synthetic peptide
  Seed: PGPVTAQVVLQAAI (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXI

SEQ ID NO: 333629 - protein, 15 aa, Artificial Sequence
  Description of Artificial Sequence: Synthetic peptide
  Seed: PGPVTAQVVLQAAIP (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIP

SEQ ID NO: 333630 - protein, 15 aa, Artificial Sequence
  Description of Artificial Sequence: Synthetic peptide
  Seed: PGPVTAQVVLQAAIP (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIP

SEQ ID NO: 333631 - protein, 16 aa, Artificial Sequence
  Description of Artificial Sequence: Synthetic peptide
  Seed: PGPVTAQVVLQAAIPL (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPL

SEQ ID NO: 333632 - protein, 16 aa, Artificial Sequence
  Description of Artificial Sequence: Synthetic peptide
  Seed: PGPVTAQVVLQAAIPL (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPL

SEQ ID NO: 333633 - protein, 16 aa, Artificial Sequence
  Description of Artificial Sequence: Synthetic peptide
  Seed: PGPVTAQVVLQAAIPL (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPX

SEQ ID NO: 333634 - protein, 17 aa, Artificial Sequence
  Description of Artificial Sequence: Synthetic peptide
  Seed: PGPVTAQVVLQAAIPLT (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLT

SEQ ID NO: 333635 - protein, 17 aa, Artificial Sequence
  Description of Artificial Sequence: Synthetic peptide
  Seed: PGPVTAQVVLQAAIPLT (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLT

SEQ ID NO: 333636 - protein, 17 aa, Artificial Sequence
  Description of Artificial Sequence: Synthetic peptide
  Seed: PGPVTAQVVLQAAIPLT (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXT

SEQ ID NO: 333637 - protein, 18 aa, Artificial Sequence
  Description of Artificial Sequence: Synthetic peptide
  Seed: PGPVTAQVVLQAAIPLTS (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTS

SEQ ID NO: 333638 - protein, 18 aa, Artificial Sequence
  Description of Artificial Sequence: Synthetic peptide
  Seed: PGPVTAQVVLQAAIPLTS (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTS

SEQ ID NO: 333639 - protein, 18 aa, Artificial Sequence
  Description of Artificial Sequence: Synthetic peptide
  Seed: PGPVTAQVVLQAAIPLTS (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTS

SEQ ID NO: 333640 - protein, 18 aa, Artificial Sequence
  Description of Artificial Sequence: Synthetic peptide
  Seed: PGPVTAQVVLQAAIPLTS (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTX

SEQ ID NO: 333641 - protein, 19 aa, Artificial Sequence
  Description of Artificial Sequence: Synthetic peptide
  Seed: PGPVTAQVVLQAAIPLTSC (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSC

SEQ ID NO: 333642 - protein, 19 aa, Artificial Sequence
  Description of Artificial Sequence: Synthetic peptide
  Seed: PGPVTAQVVLQAAIPLTSC (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSC

SEQ ID NO: 333643 - protein, 19 aa, Artificial Sequence
  Description of Artificial Sequence: Synthetic peptide
  Seed: PGPVTAQVVLQAAIPLTSC (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSC

SEQ ID NO: 333644 - protein, 19 aa, Artificial Sequence
  Description of Artificial Sequence: Synthetic peptide
  Seed: PGPVTAQVVLQAAIPLTSC (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXC

SEQ ID NO: 333645 - protein, 20 aa, Artificial Sequence
  Description of Artificial Sequence: Synthetic peptide
  Seed: PGPVTAQVVLQAAIPLTSCG (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSCG

SEQ ID NO: 333646 - protein, 20 aa, Artificial Sequence
  Description of Artificial Sequence: Synthetic peptide
  Seed: PGPVTAQVVLQAAIPLTSCG (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSCG

SEQ ID NO: 333647 - protein, 20 aa, Artificial Sequence
  Description of Artificial Sequence: Synthetic peptide
  Seed: PGPVTAQVVLQAAIPLTSCG (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSCG

SEQ ID NO: 333648 - protein, 20 aa, Artificial Sequence
  Description of Artificial Sequence: Synthetic peptide
  Seed: PGPVTAQVVLQAAIPLTSCG (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXCG

SEQ ID NO: 333649 - protein, 21 aa, Artificial Sequence
  Description of Artificial Sequence: Synthetic peptide
  Seed: PGPVTAQVVLQAAIPLTSCGS (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSCGS

SEQ ID NO: 333650 - protein, 21 aa, Artificial Sequence
  Description of Artificial Sequence: Synthetic peptide
  Seed: PGPVTAQVVLQAAIPLTSCGS (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSCGS

SEQ ID NO: 333651 - protein, 21 aa, Artificial Sequence
  Description of Artificial Sequence: Synthetic peptide
  Seed: PGPVTAQVVLQAAIPLTSCGS (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSCGS

SEQ ID NO: 333652 - protein, 21 aa, Artificial Sequence
  Description of Artificial Sequence: Synthetic peptide
  Seed: PGPVTAQVVLQAAIPLTSCGS (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXCGS

SEQ ID NO: 333653 - protein, 22 aa, Artificial Sequence
  Description of Artificial Sequence: Synthetic peptide
  Seed: PGPVTAQVVLQAAIPLTSCGSS (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSCGSS

SEQ ID NO: 333654 - protein, 22 aa, Artificial Sequence
  Description of Artificial Sequence: Synthetic peptide
  Seed: PGPVTAQVVLQAAIPLTSCGSS (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSCGSS

SEQ ID NO: 333655 - protein, 22 aa, Artificial Sequence
  Description of Artificial Sequence: Synthetic peptide
  Seed: PGPVTAQVVLQAAIPLTSCGSS (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSCGSS

SEQ ID NO: 333656 - protein, 22 aa, Artificial Sequence
  Description of Artificial Sequence: Synthetic peptide
  Seed: PGPVTAQVVLQAAIPLTSCGSS (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXCGSS

SEQ ID NO: 333657 - protein, 23 aa, Artificial Sequence
  Description of Artificial Sequence: Synthetic peptide
  Seed: PGPVTAQVVLQAAIPLTSCGSSP (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSCGSSP

SEQ ID NO: 333658 - protein, 23 aa, Artificial Sequence
  Description of Artificial Sequence: Synthetic peptide
  Seed: PGPVTAQVVLQAAIPLTSCGSSP (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSCGSSP

SEQ ID NO: 333659 - protein, 23 aa, Artificial Sequence
  Description of Artificial Sequence: Synthetic peptide
  Seed: PGPVTAQVVLQAAIPLTSCGSSP (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSCGSSP

SEQ ID NO: 333660 - protein, 23 aa, Artificial Sequence
  Description of Artificial Sequence: Synthetic peptide
  Seed: PGPVTAQVVLQAAIPLTSCGSSP (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXCGSSP

SEQ ID NO: 333661 - protein, 24 aa, Artificial Sequence
  Description of Artificial Sequence: Synthetic peptide
  Seed: PGPVTAQVVLQAAIPLTSCGSSPV (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSCGSSPV

SEQ ID NO: 333662 - protein, 24 aa, Artificial Sequence
  Description of Artificial Sequence: Synthetic peptide
  Seed: PGPVTAQVVLQAAIPLTSCGSSPV (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSCGSSPV

SEQ ID NO: 333663 - protein, 24 aa, Artificial Sequence
  Description of Artificial Sequence: Synthetic peptide
  Seed: PGPVTAQVVLQAAIPLTSCGSSPV (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSCGSSPV

SEQ ID NO: 333664 - protein, 24 aa, Artificial Sequence
  Description of Artificial Sequence: Synthetic peptide
  Seed: PGPVTAQVVLQAAIPLTSCGSSPV (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXCGSSPV

SEQ ID NO: 333665 - protein, 25 aa, Artificial Sequence
  Description of Artificial Sequence: Synthetic peptide
  Seed: PGPVTAQVVLQAAIPLTSCGSSPVP (PMEL_HUMAN)
  Core: VTAQVVLQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGPXTAXVXLQXAIPLTSCGSSPVP

SEQ ID NO: 333666 - protein, 25 aa, Artificial Sequence
  Description of Artificial Sequence: Synthetic peptide
  Seed: PGPVTAQVVLQAAIPLTSCGSSPVP (PMEL_HUMAN)
  Core: TAQVVLQAA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGPVXAQXVXQAXIPLTSCGSSPVP

SEQ ID NO: 333667 - protein, 25 aa, Artificial Sequence
  Description of Artificial Sequence: Synthetic peptide
  Seed: PGPVTAQVVLQAAIPLTSCGSSPVP (PMEL_HUMAN)
  Core: VVLQAAIPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQXVLXAXIPXTSCGSSPVP

SEQ ID NO: 333668 - protein, 25 aa, Artificial Sequence
  Description of Artificial Sequence: Synthetic peptide
  Seed: PGPVTAQVVLQAAIPLTSCGSSPVP (PMEL_HUMAN)
  Core: LQAAIPLTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PGPVTAQVVXQAXIXLTXCGSSPVP

SEQ ID NO: 333669 - protein, 15 aa, Artificial Sequence
  Description of Artificial Sequence: Synthetic peptide
  Seed: PGQAPTAEPSGTTSV (PMEL_HUMAN)
  Core: APTAEPSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGQXPTXEXSGXTSV

SEQ ID NO: 333670 - protein, 17 aa, Artificial Sequence
  Description of Artificial Sequence: Synthetic peptide
  Seed: PGQAPTAEPSGTTSVQV (PMEL_HUMAN)
  Core: APTAEPSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGQXPTXEXSGXTSVQV

SEQ ID NO: 333671 - protein, 19 aa, Artificial Sequence
  Description of Artificial Sequence: Synthetic peptide
  Seed: PGQAPTAEPSGTTSVQVPT (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPT

SEQ ID NO: 333672 - protein, 20 aa, Artificial Sequence
  Description of Artificial Sequence: Synthetic peptide
  Seed: PGQAPTAEPSGTTSVQVPTT (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPTT

SEQ ID NO: 333673 - protein, 21 aa, Artificial Sequence
  Description of Artificial Sequence: Synthetic peptide
  Seed: PGQAPTAEPSGTTSVQVPTTE (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPTTE

SEQ ID NO: 333674 - protein, 22 aa, Artificial Sequence
  Description of Artificial Sequence: Synthetic peptide
  Seed: PGQAPTAEPSGTTSVQVPTTEV (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPTTEV

SEQ ID NO: 333675 - protein, 23 aa, Artificial Sequence
  Description of Artificial Sequence: Synthetic peptide
  Seed: PGQAPTAEPSGTTSVQVPTTEVI (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPTTEVI

SEQ ID NO: 333676 - protein, 24 aa, Artificial Sequence
  Description of Artificial Sequence: Synthetic peptide
  Seed: PGQAPTAEPSGTTSVQVPTTEVIS (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPTTEVIS

SEQ ID NO: 333677 - protein, 25 aa, Artificial Sequence
  Description of Artificial Sequence: Synthetic peptide
  Seed: PGQAPTAEPSGTTSVQVPTTEVIST (PMEL_HUMAN)
  Core: PSGTTSVQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGQAPTAEXSGXTXVQXPTTEVIST

SEQ ID NO: 333678 - protein, 14 aa, Artificial Sequence
  Description of Artificial Sequence: Synthetic peptide
  Seed: PGQEAGLGQVPLIV (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXV

SEQ ID NO: 333679 - protein, 15 aa, Artificial Sequence
  Description of Artificial Sequence: Synthetic peptide
  Seed: PGQEAGLGQVPLIVG (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVG

SEQ ID NO: 333680 - protein, 16 aa, Artificial Sequence
  Description of Artificial Sequence: Synthetic peptide
  Seed: PGQEAGLGQVPLIVGI (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGI

SEQ ID NO: 333681 - protein, 16 aa, Artificial Sequence
  Description of Artificial Sequence: Synthetic peptide
  Seed: PGQEAGLGQVPLIVGI (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXI

SEQ ID NO: 333682 - protein, 17 aa, Artificial Sequence
  Description of Artificial Sequence: Synthetic peptide
  Seed: PGQEAGLGQVPLIVGIL (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGIL

SEQ ID NO: 333683 - protein, 17 aa, Artificial Sequence
  Description of Artificial Sequence: Synthetic peptide
  Seed: PGQEAGLGQVPLIVGIL (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXIL

SEQ ID NO: 333684 - protein, 18 aa, Artificial Sequence
  Description of Artificial Sequence: Synthetic peptide
  Seed: PGQEAGLGQVPLIVGILL (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILL

SEQ ID NO: 333685 - protein, 19 aa, Artificial Sequence
  Description of Artificial Sequence: Synthetic peptide
  Seed: PGQEAGLGQVPLIVGILLV (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGILLV

SEQ ID NO: 333686 - protein, 19 aa, Artificial Sequence
  Description of Artificial Sequence: Synthetic peptide
  Seed: PGQEAGLGQVPLIVGILLV (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLV

SEQ ID NO: 333687 - protein, 19 aa, Artificial Sequence
  Description of Artificial Sequence: Synthetic peptide
  Seed: PGQEAGLGQVPLIVGILLV (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLV

SEQ ID NO: 333688 - protein, 20 aa, Artificial Sequence
  Description of Artificial Sequence: Synthetic peptide
  Seed: PGQEAGLGQVPLIVGILLVL (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGILLVL

SEQ ID NO: 333689 - protein, 20 aa, Artificial Sequence
  Description of Artificial Sequence: Synthetic peptide
  Seed: PGQEAGLGQVPLIVGILLVL (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLVL

SEQ ID NO: 333690 - protein, 20 aa, Artificial Sequence
  Description of Artificial Sequence: Synthetic peptide
  Seed: PGQEAGLGQVPLIVGILLVL (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLVL

SEQ ID NO: 333691 - protein, 21 aa, Artificial Sequence
  Description of Artificial Sequence: Synthetic peptide
  Seed: PGQEAGLGQVPLIVGILLVLM (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLVLM

SEQ ID NO: 333692 - protein, 21 aa, Artificial Sequence
  Description of Artificial Sequence: Synthetic peptide
  Seed: PGQEAGLGQVPLIVGILLVLM (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLVLM

SEQ ID NO: 333693 - protein, 22 aa, Artificial Sequence
  Description of Artificial Sequence: Synthetic peptide
  Seed: PGQEAGLGQVPLIVGILLVLMA (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLVLMA

SEQ ID NO: 333694 - protein, 22 aa, Artificial Sequence
  Description of Artificial Sequence: Synthetic peptide
  Seed: PGQEAGLGQVPLIVGILLVLMA (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLVLMA

SEQ ID NO: 333695 - protein, 22 aa, Artificial Sequence
  Description of Artificial Sequence: Synthetic peptide
  Seed: PGQEAGLGQVPLIVGILLVLMA (PMEL_HUMAN)
  Core: IVGILLVLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGLGQVPLXVGXLXVLXA

SEQ ID NO: 333696 - protein, 23 aa, Artificial Sequence
  Description of Artificial Sequence: Synthetic peptide
  Seed: PGQEAGLGQVPLIVGILLVLMAV (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGILLVLMAV

SEQ ID NO: 333697 - protein, 23 aa, Artificial Sequence
  Description of Artificial Sequence: Synthetic peptide
  Seed: PGQEAGLGQVPLIVGILLVLMAV (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLVLMAV

SEQ ID NO: 333698 - protein, 23 aa, Artificial Sequence
  Description of Artificial Sequence: Synthetic peptide
  Seed: PGQEAGLGQVPLIVGILLVLMAV (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLVLMAV

SEQ ID NO: 333699 - protein, 23 aa, Artificial Sequence
  Description of Artificial Sequence: Synthetic peptide
  Seed: PGQEAGLGQVPLIVGILLVLMAV (PMEL_HUMAN)
  Core: LIVGILLVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGLGQVPXIVXIXLVXMAV

SEQ ID NO: 333700 - protein, 24 aa, Artificial Sequence
  Description of Artificial Sequence: Synthetic peptide
  Seed: PGQEAGLGQVPLIVGILLVLMAVV (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGILLVLMAVV

SEQ ID NO: 333701 - protein, 24 aa, Artificial Sequence
  Description of Artificial Sequence: Synthetic peptide
  Seed: PGQEAGLGQVPLIVGILLVLMAVV (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLVLMAVV

SEQ ID NO: 333702 - protein, 24 aa, Artificial Sequence
  Description of Artificial Sequence: Synthetic peptide
  Seed: PGQEAGLGQVPLIVGILLVLMAVV (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLVLMAVV

SEQ ID NO: 333703 - protein, 24 aa, Artificial Sequence
  Description of Artificial Sequence: Synthetic peptide
  Seed: PGQEAGLGQVPLIVGILLVLMAVV (PMEL_HUMAN)
  Core: LIVGILLVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGLGQVPXIVXIXLVXMAVV

SEQ ID NO: 333704 - protein, 24 aa, Artificial Sequence
  Description of Artificial Sequence: Synthetic peptide
  Seed: PGQEAGLGQVPLIVGILLVLMAVV (PMEL_HUMAN)
  Core: IVGILLVLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGLGQVPLXVGXLXVLXAVV

SEQ ID NO: 333705 - protein, 25 aa, Artificial Sequence
  Description of Artificial Sequence: Synthetic peptide
  Seed: PGQEAGLGQVPLIVGILLVLMAVVL (PMEL_HUMAN)
  Core: AGLGQVPLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGQEXGLXQXPLXVGILLVLMAVVL

SEQ ID NO: 333706 - protein, 25 aa, Artificial Sequence
  Description of Artificial Sequence: Synthetic peptide
  Seed: PGQEAGLGQVPLIVGILLVLMAVVL (PMEL_HUMAN)
  Core: GLGQVPLIV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAXLGXVXLIXGILLVLMAVVL

SEQ ID NO: 333707 - protein, 25 aa, Artificial Sequence
  Description of Artificial Sequence: Synthetic peptide
  Seed: PGQEAGLGQVPLIVGILLVLMAVVL (PMEL_HUMAN)
  Core: LGQVPLIVG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGXGQXPXIVXILLVLMAVVL

SEQ ID NO: 333708 - protein, 25 aa, Artificial Sequence
  Description of Artificial Sequence: Synthetic peptide
  Seed: PGQEAGLGQVPLIVGILLVLMAVVL (PMEL_HUMAN)
  Core: LIVGILLVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGLGQVPXIVXIXLVXMAVVL

SEQ ID NO: 333709 - protein, 25 aa, Artificial Sequence
  Description of Artificial Sequence: Synthetic peptide
  Seed: PGQEAGLGQVPLIVGILLVLMAVVL (PMEL_HUMAN)
  Core: IVGILLVLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGQEAGLGQVPLXVGXLXVLXAVVL

SEQ ID NO: 333710 - protein, 15 aa, Artificial Sequence
  Description of Artificial Sequence: Synthetic peptide
  Seed: PGSQKVLPDGQVIWV (PMEL_HUMAN)
  Core: VLPDGQVIW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKXLPXGXVIXV

SEQ ID NO: 333711 - protein, 19 aa, Artificial Sequence
  Description of Artificial Sequence: Synthetic peptide
  Seed: PGSQKVLPDGQVIWVNNTI (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTX

SEQ ID NO: 333712 - protein, 20 aa, Artificial Sequence
  Description of Artificial Sequence: Synthetic peptide
  Seed: PGSQKVLPDGQVIWVNNTII (PMEL_HUMAN)
  Core: VLPDGQVIW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKXLPXGXVIXVNNTII

SEQ ID NO: 333713 - protein, 20 aa, Artificial Sequence
  Description of Artificial Sequence: Synthetic peptide
  Seed: PGSQKVLPDGQVIWVNNTII (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTXI

SEQ ID NO: 333714 - protein, 20 aa, Artificial Sequence
  Description of Artificial Sequence: Synthetic peptide
  Seed: PGSQKVLPDGQVIWVNNTII (PMEL_HUMAN)
  Core: VIWVNNTII
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQXIWXNXTIX

SEQ ID NO: 333715 - protein, 21 aa, Artificial Sequence
  Description of Artificial Sequence: Synthetic peptide
  Seed: PGSQKVLPDGQVIWVNNTIIN (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTXIN

SEQ ID NO: 333716 - protein, 21 aa, Artificial Sequence
  Description of Artificial Sequence: Synthetic peptide
  Seed: PGSQKVLPDGQVIWVNNTIIN (PMEL_HUMAN)
  Core: VIWVNNTII
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQXIWXNXTIXN

SEQ ID NO: 333717 - protein, 21 aa, Artificial Sequence
  Description of Artificial Sequence: Synthetic peptide
  Seed: PGSQKVLPDGQVIWVNNTIIN (PMEL_HUMAN)
  Core: IWVNNTIIN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQVXWVXNXIIX

SEQ ID NO: 333718 - protein, 22 aa, Artificial Sequence
  Description of Artificial Sequence: Synthetic peptide
  Seed: PGSQKVLPDGQVIWVNNTIING (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTXING

SEQ ID NO: 333719 - protein, 22 aa, Artificial Sequence
  Description of Artificial Sequence: Synthetic peptide
  Seed: PGSQKVLPDGQVIWVNNTIING (PMEL_HUMAN)
  Core: VIWVNNTII
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQXIWXNXTIXNG

SEQ ID NO: 333720 - protein, 22 aa, Artificial Sequence
  Description of Artificial Sequence: Synthetic peptide
  Seed: PGSQKVLPDGQVIWVNNTIING (PMEL_HUMAN)
  Core: IWVNNTIIN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQVXWVXNXIIXG

SEQ ID NO: 333721 - protein, 23 aa, Artificial Sequence
  Description of Artificial Sequence: Synthetic peptide
  Seed: PGSQKVLPDGQVIWVNNTIINGS (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTXINGS

SEQ ID NO: 333722 - protein, 23 aa, Artificial Sequence
  Description of Artificial Sequence: Synthetic peptide
  Seed: PGSQKVLPDGQVIWVNNTIINGS (PMEL_HUMAN)
  Core: VIWVNNTII
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQXIWXNXTIXNGS

SEQ ID NO: 333723 - protein, 23 aa, Artificial Sequence
  Description of Artificial Sequence: Synthetic peptide
  Seed: PGSQKVLPDGQVIWVNNTIINGS (PMEL_HUMAN)
  Core: IWVNNTIIN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQVXWVXNXIIXGS

SEQ ID NO: 333724 - protein, 24 aa, Artificial Sequence
  Description of Artificial Sequence: Synthetic peptide
  Seed: PGSQKVLPDGQVIWVNNTIINGSQ (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTXINGSQ

SEQ ID NO: 333725 - protein, 24 aa, Artificial Sequence
  Description of Artificial Sequence: Synthetic peptide
  Seed: PGSQKVLPDGQVIWVNNTIINGSQ (PMEL_HUMAN)
  Core: VIWVNNTII
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQXIWXNXTIXNGSQ

SEQ ID NO: 333726 - protein, 24 aa, Artificial Sequence
  Description of Artificial Sequence: Synthetic peptide
  Seed: PGSQKVLPDGQVIWVNNTIINGSQ (PMEL_HUMAN)
  Core: IWVNNTIIN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQVXWVXNXIIXGSQ

SEQ ID NO: 333727 - protein, 25 aa, Artificial Sequence
  Description of Artificial Sequence: Synthetic peptide
  Seed: PGSQKVLPDGQVIWVNNTIINGSQV (PMEL_HUMAN)
  Core: QVIWVNNTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGXVIXVXNTXINGSQV

SEQ ID NO: 333728 - protein, 25 aa, Artificial Sequence
  Description of Artificial Sequence: Synthetic peptide
  Seed: PGSQKVLPDGQVIWVNNTIINGSQV (PMEL_HUMAN)
  Core: VIWVNNTII
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQXIWXNXTIXNGSQV

SEQ ID NO: 333729 - protein, 25 aa, Artificial Sequence
  Description of Artificial Sequence: Synthetic peptide
  Seed: PGSQKVLPDGQVIWVNNTIINGSQV (PMEL_HUMAN)
  Core: IWVNNTIIN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PGSQKVLPDGQVXWVXNXIIXGSQV

SEQ ID NO: 333730 - protein, 24 aa, Artificial Sequence
  Description of Artificial Sequence: Synthetic peptide
  Seed: PGTTDGHRPTAEAPNTTAGQVPTT (PMEL_HUMAN)
  Core: PTAEAPNTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PGTTDGHRXTAXAXNTXAGQVPTT

SEQ ID NO: 333731 - protein, 25 aa, Artificial Sequence
  Description of Artificial Sequence: Synthetic peptide
  Seed: PGTTDGHRPTAEAPNTTAGQVPTTE (PMEL_HUMAN)
  Core: TTAGQVPTT
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PGTTDGHRPTAEAPNXTAXQXPTXE

SEQ ID NO: 333732 - protein, 14 aa, Artificial Sequence
  Description of Artificial Sequence: Synthetic peptide
  Seed: PHSSSHWLRLPRIF (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIF

SEQ ID NO: 333733 - protein, 14 aa, Artificial Sequence
  Description of Artificial Sequence: Synthetic peptide
  Seed: PHSSSHWLRLPRIF (PMEL_HUMAN)
  Core: SSHWLRLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHSXSHXLXLPXIF

SEQ ID NO: 333734 - protein, 14 aa, Artificial Sequence
  Description of Artificial Sequence: Synthetic peptide
  Seed: PHSSSHWLRLPRIF (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXF

SEQ ID NO: 333735 - protein, 15 aa, Artificial Sequence
  Description of Artificial Sequence: Synthetic peptide
  Seed: PHSSSHWLRLPRIFC (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFC

SEQ ID NO: 333736 - protein, 15 aa, Artificial Sequence
  Description of Artificial Sequence: Synthetic peptide
  Seed: PHSSSHWLRLPRIFC (PMEL_HUMAN)
  Core: SSHWLRLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHSXSHXLXLPXIFC

SEQ ID NO: 333737 - protein, 15 aa, Artificial Sequence
  Description of Artificial Sequence: Synthetic peptide
  Seed: PHSSSHWLRLPRIFC (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFC

SEQ ID NO: 333738 - protein, 15 aa, Artificial Sequence
  Description of Artificial Sequence: Synthetic peptide
  Seed: PHSSSHWLRLPRIFC (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFX

SEQ ID NO: 333739 - protein, 16 aa, Artificial Sequence
  Description of Artificial Sequence: Synthetic peptide
  Seed: PHSSSHWLRLPRIFCS (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCS

SEQ ID NO: 333740 - protein, 16 aa, Artificial Sequence
  Description of Artificial Sequence: Synthetic peptide
  Seed: PHSSSHWLRLPRIFCS (PMEL_HUMAN)
  Core: SSHWLRLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHSXSHXLXLPXIFCS

SEQ ID NO: 333741 - protein, 16 aa, Artificial Sequence
  Description of Artificial Sequence: Synthetic peptide
  Seed: PHSSSHWLRLPRIFCS (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCS

SEQ ID NO: 333742 - protein, 16 aa, Artificial Sequence
  Description of Artificial Sequence: Synthetic peptide
  Seed: PHSSSHWLRLPRIFCS (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXS

SEQ ID NO: 333743 - protein, 17 aa, Artificial Sequence
  Description of Artificial Sequence: Synthetic peptide
  Seed: PHSSSHWLRLPRIFCSC (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSC

SEQ ID NO: 333744 - protein, 17 aa, Artificial Sequence
  Description of Artificial Sequence: Synthetic peptide
  Seed: PHSSSHWLRLPRIFCSC (PMEL_HUMAN)
  Core: SSHWLRLPR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PHSXSHXLXLPXIFCSC

SEQ ID NO: 333745 - protein, 17 aa, Artificial Sequence
  Description of Artificial Sequence: Synthetic peptide
  Seed: PHSSSHWLRLPRIFCSC (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSC

SEQ ID NO: 333746 - protein, 17 aa, Artificial Sequence
  Description of Artificial Sequence: Synthetic peptide
  Seed: PHSSSHWLRLPRIFCSC (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSC

SEQ ID NO: 333747 - protein, 18 aa, Artificial Sequence
  Description of Artificial Sequence: Synthetic peptide
  Seed: PHSSSHWLRLPRIFCSCP (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCP

SEQ ID NO: 333748 - protein, 19 aa, Artificial Sequence
  Description of Artificial Sequence: Synthetic peptide
  Seed: PHSSSHWLRLPRIFCSCPI (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPI

SEQ ID NO: 333749 - protein, 19 aa, Artificial Sequence
  Description of Artificial Sequence: Synthetic peptide
  Seed: PHSSSHWLRLPRIFCSCPI (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPI

SEQ ID NO: 333750 - protein, 19 aa, Artificial Sequence
  Description of Artificial Sequence: Synthetic peptide
  Seed: PHSSSHWLRLPRIFCSCPI (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPI

SEQ ID NO: 333751 - protein, 20 aa, Artificial Sequence
  Description of Artificial Sequence: Synthetic peptide
  Seed: PHSSSHWLRLPRIFCSCPIG (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPIG

SEQ ID NO: 333752 - protein, 20 aa, Artificial Sequence
  Description of Artificial Sequence: Synthetic peptide
  Seed: PHSSSHWLRLPRIFCSCPIG (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPIG

SEQ ID NO: 333753 - protein, 20 aa, Artificial Sequence
  Description of Artificial Sequence: Synthetic peptide
  Seed: PHSSSHWLRLPRIFCSCPIG (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPIG

SEQ ID NO: 333754 - protein, 20 aa, Artificial Sequence
  Description of Artificial Sequence: Synthetic peptide
  Seed: PHSSSHWLRLPRIFCSCPIG (PMEL_HUMAN)
  Core: LRLPRIFCS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWXRLXRXFCXCPIG

SEQ ID NO: 333755 - protein, 20 aa, Artificial Sequence
  Description of Artificial Sequence: Synthetic peptide
  Seed: PHSSSHWLRLPRIFCSCPIG (PMEL_HUMAN)
  Core: RLPRIFCSC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLXLPXIXCSXPIG

SEQ ID NO: 333756 - protein, 20 aa, Artificial Sequence
  Description of Artificial Sequence: Synthetic peptide
  Seed: PHSSSHWLRLPRIFCSCPIG (PMEL_HUMAN)
  Core: PRIFCSCPI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLXRIXCXCPXG

SEQ ID NO: 333757 - protein, 21 aa, Artificial Sequence
  Description of Artificial Sequence: Synthetic peptide
  Seed: PHSSSHWLRLPRIFCSCPIGE (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPIGE

SEQ ID NO: 333758 - protein, 21 aa, Artificial Sequence
  Description of Artificial Sequence: Synthetic peptide
  Seed: PHSSSHWLRLPRIFCSCPIGE (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPIGE

SEQ ID NO: 333759 - protein, 21 aa, Artificial Sequence
  Description of Artificial Sequence: Synthetic peptide
  Seed: PHSSSHWLRLPRIFCSCPIGE (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPIGE

SEQ ID NO: 333760 - protein, 21 aa, Artificial Sequence
  Description of Artificial Sequence: Synthetic peptide
  Seed: PHSSSHWLRLPRIFCSCPIGE (PMEL_HUMAN)
  Core: RLPRIFCSC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLXLPXIXCSXPIGE

SEQ ID NO: 333761 - protein, 21 aa, Artificial Sequence
  Description of Artificial Sequence: Synthetic peptide
  Seed: PHSSSHWLRLPRIFCSCPIGE (PMEL_HUMAN)
  Core: PRIFCSCPI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLXRIXCXCPXGE

SEQ ID NO: 333762 - protein, 22 aa, Artificial Sequence
  Description of Artificial Sequence: Synthetic peptide
  Seed: PHSSSHWLRLPRIFCSCPIGEN (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPIGEN

SEQ ID NO: 333763 - protein, 22 aa, Artificial Sequence
  Description of Artificial Sequence: Synthetic peptide
  Seed: PHSSSHWLRLPRIFCSCPIGEN (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPIGEN

SEQ ID NO: 333764 - protein, 22 aa, Artificial Sequence
  Description of Artificial Sequence: Synthetic peptide
  Seed: PHSSSHWLRLPRIFCSCPIGEN (PMEL_HUMAN)
  Core: HWLRLPRIF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSXWLXLXRIXCSCPIGEN

SEQ ID NO: 333765 - protein, 22 aa, Artificial Sequence
  Description of Artificial Sequence: Synthetic peptide
  Seed: PHSSSHWLRLPRIFCSCPIGEN (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPIGEN

SEQ ID NO: 333766 - protein, 22 aa, Artificial Sequence
  Description of Artificial Sequence: Synthetic peptide
  Seed: PHSSSHWLRLPRIFCSCPIGEN (PMEL_HUMAN)
  Core: RLPRIFCSC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLXLPXIXCSXPIGEN

SEQ ID NO: 333767 - protein, 22 aa, Artificial Sequence
  Description of Artificial Sequence: Synthetic peptide
  Seed: PHSSSHWLRLPRIFCSCPIGEN (PMEL_HUMAN)
  Core: PRIFCSCPI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLXRIXCXCPXGEN

SEQ ID NO: 333768 - protein, 22 aa, Artificial Sequence
  Description of Artificial Sequence: Synthetic peptide
  Seed: PHSSSHWLRLPRIFCSCPIGEN (PMEL_HUMAN)
  Core: RIFCSCPIG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPXIFXSXPIXEN

SEQ ID NO: 333769 - protein, 23 aa, Artificial Sequence
  Description of Artificial Sequence: Synthetic peptide
  Seed: PHSSSHWLRLPRIFCSCPIGENS (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPIGENS

SEQ ID NO: 333770 - protein, 23 aa, Artificial Sequence
  Description of Artificial Sequence: Synthetic peptide
  Seed: PHSSSHWLRLPRIFCSCPIGENS (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPIGENS

SEQ ID NO: 333771 - protein, 23 aa, Artificial Sequence
  Description of Artificial Sequence: Synthetic peptide
  Seed: PHSSSHWLRLPRIFCSCPIGENS (PMEL_HUMAN)
  Core: HWLRLPRIF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSXWLXLXRIXCSCPIGENS

SEQ ID NO: 333772 - protein, 23 aa, Artificial Sequence
  Description of Artificial Sequence: Synthetic peptide
  Seed: PHSSSHWLRLPRIFCSCPIGENS (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPIGENS

SEQ ID NO: 333773 - protein, 23 aa, Artificial Sequence
  Description of Artificial Sequence: Synthetic peptide
  Seed: PHSSSHWLRLPRIFCSCPIGENS (PMEL_HUMAN)
  Core: RLPRIFCSC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLXLPXIXCSXPIGENS

SEQ ID NO: 333774 - protein, 23 aa, Artificial Sequence
  Description of Artificial Sequence: Synthetic peptide
  Seed: PHSSSHWLRLPRIFCSCPIGENS (PMEL_HUMAN)
  Core: PRIFCSCPI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLXRIXCXCPXGENS

SEQ ID NO: 333775 - protein, 23 aa, Artificial Sequence
  Description of Artificial Sequence: Synthetic peptide
  Seed: PHSSSHWLRLPRIFCSCPIGENS (PMEL_HUMAN)
  Core: RIFCSCPIG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPXIFXSXPIXENS

SEQ ID NO: 333776 - protein, 23 aa, Artificial Sequence
  Description of Artificial Sequence: Synthetic peptide
  Seed: PHSSSHWLRLPRIFCSCPIGENS (PMEL_HUMAN)
  Core: IFCSCPIGE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPRXFCXCXIGXNS

SEQ ID NO: 333777 - protein, 23 aa, Artificial Sequence
  Description of Artificial Sequence: Synthetic peptide
  Seed: PHSSSHWLRLPRIFCSCPIGENS (PMEL_HUMAN)
  Core: FCSCPIGEN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPRIXCSXPXGEXS

SEQ ID NO: 333778 - protein, 24 aa, Artificial Sequence
  Description of Artificial Sequence: Synthetic peptide
  Seed: PHSSSHWLRLPRIFCSCPIGENSP (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPIGENSP

SEQ ID NO: 333779 - protein, 24 aa, Artificial Sequence
  Description of Artificial Sequence: Synthetic peptide
  Seed: PHSSSHWLRLPRIFCSCPIGENSP (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPIGENSP

SEQ ID NO: 333780 - protein, 24 aa, Artificial Sequence
  Description of Artificial Sequence: Synthetic peptide
  Seed: PHSSSHWLRLPRIFCSCPIGENSP (PMEL_HUMAN)
  Core: HWLRLPRIF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSXWLXLXRIXCSCPIGENSP

SEQ ID NO: 333781 - protein, 24 aa, Artificial Sequence
  Description of Artificial Sequence: Synthetic peptide
  Seed: PHSSSHWLRLPRIFCSCPIGENSP (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPIGENSP

SEQ ID NO: 333782 - protein, 24 aa, Artificial Sequence
  Description of Artificial Sequence: Synthetic peptide
  Seed: PHSSSHWLRLPRIFCSCPIGENSP (PMEL_HUMAN)
  Core: RLPRIFCSC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLXLPXIXCSXPIGENSP

SEQ ID NO: 333783 - protein, 24 aa, Artificial Sequence
  Description of Artificial Sequence: Synthetic peptide
  Seed: PHSSSHWLRLPRIFCSCPIGENSP (PMEL_HUMAN)
  Core: PRIFCSCPI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLXRIXCXCPXGENSP

SEQ ID NO: 333784 - protein, 24 aa, Artificial Sequence
  Description of Artificial Sequence: Synthetic peptide
  Seed: PHSSSHWLRLPRIFCSCPIGENSP (PMEL_HUMAN)
  Core: RIFCSCPIG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPXIFXSXPIXENSP

SEQ ID NO: 333785 - protein, 24 aa, Artificial Sequence
  Description of Artificial Sequence: Synthetic peptide
  Seed: PHSSSHWLRLPRIFCSCPIGENSP (PMEL_HUMAN)
  Core: IFCSCPIGE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPRXFCXCXIGXNSP

SEQ ID NO: 333786 - protein, 24 aa, Artificial Sequence
  Description of Artificial Sequence: Synthetic peptide
  Seed: PHSSSHWLRLPRIFCSCPIGENSP (PMEL_HUMAN)
  Core: FCSCPIGEN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPRIXCSXPXGEXSP

SEQ ID NO: 333787 - protein, 25 aa, Artificial Sequence
  Description of Artificial Sequence: Synthetic peptide
  Seed: PHSSSHWLRLPRIFCSCPIGENSPL (PMEL_HUMAN)
  Core: HSSSHWLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSSXHXLRXPRIFCSCPIGENSPL

SEQ ID NO: 333788 - protein, 25 aa, Artificial Sequence
  Description of Artificial Sequence: Synthetic peptide
  Seed: PHSSSHWLRLPRIFCSCPIGENSPL (PMEL_HUMAN)
  Core: SHWLRLPRI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PHSSXHWXRXPRXFCSCPIGENSPL

SEQ ID NO: 333789 - protein, 25 aa, Artificial Sequence
  Description of Artificial Sequence: Synthetic peptide
  Seed: PHSSSHWLRLPRIFCSCPIGENSPL (PMEL_HUMAN)
  Core: HWLRLPRIF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSXWLXLXRIXCSCPIGENSPL

SEQ ID NO: 333790 - protein, 25 aa, Artificial Sequence
  Description of Artificial Sequence: Synthetic peptide
  Seed: PHSSSHWLRLPRIFCSCPIGENSPL (PMEL_HUMAN)
  Core: WLRLPRIFC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHXLRXPXIFXSCPIGENSPL

SEQ ID NO: 333791 - protein, 25 aa, Artificial Sequence
  Description of Artificial Sequence: Synthetic peptide
  Seed: PHSSSHWLRLPRIFCSCPIGENSPL (PMEL_HUMAN)
  Core: RLPRIFCSC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLXLPXIXCSXPIGENSPL

SEQ ID NO: 333792 - protein, 25 aa, Artificial Sequence
  Description of Artificial Sequence: Synthetic peptide
  Seed: PHSSSHWLRLPRIFCSCPIGENSPL (PMEL_HUMAN)
  Core: PRIFCSCPI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLXRIXCXCPXGENSPL

SEQ ID NO: 333793 - protein, 25 aa, Artificial Sequence
  Description of Artificial Sequence: Synthetic peptide
  Seed: PHSSSHWLRLPRIFCSCPIGENSPL (PMEL_HUMAN)
  Core: RIFCSCPIG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPXIFXSXPIXENSPL

SEQ ID NO: 333794 - protein, 25 aa, Artificial Sequence
  Description of Artificial Sequence: Synthetic peptide
  Seed: PHSSSHWLRLPRIFCSCPIGENSPL (PMEL_HUMAN)
  Core: IFCSCPIGE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPRXFCXCXIGXNSPL

SEQ ID NO: 333795 - protein, 25 aa, Artificial Sequence
  Description of Artificial Sequence: Synthetic peptide
  Seed: PHSSSHWLRLPRIFCSCPIGENSPL (PMEL_HUMAN)
  Core: FCSCPIGEN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PHSSSHWLRLPRIXCSXPXGEXSPL

SEQ ID NO: 333796 - protein, 16 aa, Artificial Sequence
  Description of Artificial Sequence: Synthetic peptide
  Seed: PIPEPEGPDASSIMST (PMEL_HUMAN)
  Core: PEGPDASSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PIPEXEGXDXSSXMST

SEQ ID NO: 333797 - protein, 17 aa, Artificial Sequence
  Description of Artificial Sequence: Synthetic peptide
  Seed: PIPEPEGPDASSIMSTE (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXE

SEQ ID NO: 333798 - protein, 19 aa, Artificial Sequence
  Description of Artificial Sequence: Synthetic peptide
  Seed: PIPEPEGPDASSIMSTESI (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESI

SEQ ID NO: 333799 - protein, 20 aa, Artificial Sequence
  Description of Artificial Sequence: Synthetic peptide
  Seed: PIPEPEGPDASSIMSTESIT (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESIT

SEQ ID NO: 333800 - protein, 21 aa, Artificial Sequence
  Description of Artificial Sequence: Synthetic peptide
  Seed: PIPEPEGPDASSIMSTESITG (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESITG

SEQ ID NO: 333801 - protein, 22 aa, Artificial Sequence
  Description of Artificial Sequence: Synthetic peptide
  Seed: PIPEPEGPDASSIMSTESITGS (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESITGS

SEQ ID NO: 333802 - protein, 23 aa, Artificial Sequence
  Description of Artificial Sequence: Synthetic peptide
  Seed: PIPEPEGPDASSIMSTESITGSL (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESITGSL

SEQ ID NO: 333803 - protein, 24 aa, Artificial Sequence
  Description of Artificial Sequence: Synthetic peptide
  Seed: PIPEPEGPDASSIMSTESITGSLG (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESITGSLG

SEQ ID NO: 333804 - protein, 25 aa, Artificial Sequence
  Description of Artificial Sequence: Synthetic peptide
  Seed: PIPEPEGPDASSIMSTESITGSLGP (PMEL_HUMAN)
  Core: PDASSIMST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PIPEPEGXDAXSXMSXESITGSLGP

SEQ ID NO: 333805 - protein, 13 aa, Artificial Sequence
  Description of Artificial Sequence: Synthetic peptide
  Seed: PLAHSSSAFTITD (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTD

SEQ ID NO: 333806 - protein, 14 aa, Artificial Sequence
  Description of Artificial Sequence: Synthetic peptide
  Seed: PLAHSSSAFTITDQ (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQ

SEQ ID NO: 333807 - protein, 15 aa, Artificial Sequence
  Description of Artificial Sequence: Synthetic peptide
  Seed: PLAHSSSAFTITDQV (PMEL_HUMAN)
  Core: LAHSSSAFT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXAHXSXAFXITDQV

SEQ ID NO: 333808 - protein, 15 aa, Artificial Sequence
  Description of Artificial Sequence: Synthetic peptide
  Seed: PLAHSSSAFTITDQV (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQV

SEQ ID NO: 333809 - protein, 15 aa, Artificial Sequence
  Description of Artificial Sequence: Synthetic peptide
  Seed: PLAHSSSAFTITDQV (PMEL_HUMAN)
  Core: SSSAFTITD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLAHXSSXFXITXQV

SEQ ID NO: 333810 - protein, 15 aa, Artificial Sequence
  Description of Artificial Sequence: Synthetic peptide
  Seed: PLAHSSSAFTITDQV (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXV

SEQ ID NO: 333811 - protein, 16 aa, Artificial Sequence
  Description of Artificial Sequence: Synthetic peptide
  Seed: PLAHSSSAFTITDQVP (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVP

SEQ ID NO: 333812 - protein, 16 aa, Artificial Sequence
  Description of Artificial Sequence: Synthetic peptide
  Seed: PLAHSSSAFTITDQVP (PMEL_HUMAN)
  Core: SSSAFTITD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLAHXSSXFXITXQVP

SEQ ID NO: 333813 - protein, 16 aa, Artificial Sequence
  Description of Artificial Sequence: Synthetic peptide
  Seed: PLAHSSSAFTITDQVP (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXVP

SEQ ID NO: 333814 - protein, 16 aa, Artificial Sequence
  Description of Artificial Sequence: Synthetic peptide
  Seed: PLAHSSSAFTITDQVP (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXP

SEQ ID NO: 333815 - protein, 17 aa, Artificial Sequence
  Description of Artificial Sequence: Synthetic peptide
  Seed: PLAHSSSAFTITDQVPF (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPF

SEQ ID NO: 333816 - protein, 17 aa, Artificial Sequence
  Description of Artificial Sequence: Synthetic peptide
  Seed: PLAHSSSAFTITDQVPF (PMEL_HUMAN)
  Core: HSSSAFTIT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLAXSSXAXTIXDQVPF

SEQ ID NO: 333817 - protein, 17 aa, Artificial Sequence
  Description of Artificial Sequence: Synthetic peptide
  Seed: PLAHSSSAFTITDQVPF (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXVPF

SEQ ID NO: 333818 - protein, 17 aa, Artificial Sequence
  Description of Artificial Sequence: Synthetic peptide
  Seed: PLAHSSSAFTITDQVPF (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPF

SEQ ID NO: 333819 - protein, 17 aa, Artificial Sequence
  Description of Artificial Sequence: Synthetic peptide
  Seed: PLAHSSSAFTITDQVPF (PMEL_HUMAN)
  Core: AFTITDQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSXFTXTXQVXF

SEQ ID NO: 333820 - protein, 18 aa, Artificial Sequence
  Description of Artificial Sequence: Synthetic peptide
  Seed: PLAHSSSAFTITDQVPFS (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFS

SEQ ID NO: 333821 - protein, 18 aa, Artificial Sequence
  Description of Artificial Sequence: Synthetic peptide
  Seed: PLAHSSSAFTITDQVPFS (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFS

SEQ ID NO: 333822 - protein, 19 aa, Artificial Sequence
  Description of Artificial Sequence: Synthetic peptide
  Seed: PLAHSSSAFTITDQVPFSV (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFSV

SEQ ID NO: 333823 - protein, 19 aa, Artificial Sequence
  Description of Artificial Sequence: Synthetic peptide
  Seed: PLAHSSSAFTITDQVPFSV (PMEL_HUMAN)
  Core: HSSSAFTIT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLAXSSXAXTIXDQVPFSV

SEQ ID NO: 333824 - protein, 19 aa, Artificial Sequence
  Description of Artificial Sequence: Synthetic peptide
  Seed: PLAHSSSAFTITDQVPFSV (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSV

SEQ ID NO: 333825 - protein, 19 aa, Artificial Sequence
  Description of Artificial Sequence: Synthetic peptide
  Seed: PLAHSSSAFTITDQVPFSV (PMEL_HUMAN)
  Core: AFTITDQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSXFTXTXQVXFSV

SEQ ID NO: 333826 - protein, 19 aa, Artificial Sequence
  Description of Artificial Sequence: Synthetic peptide
  Seed: PLAHSSSAFTITDQVPFSV (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSV

SEQ ID NO: 333827 - protein, 20 aa, Artificial Sequence
  Description of Artificial Sequence: Synthetic peptide
  Seed: PLAHSSSAFTITDQVPFSVS (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFSVS

SEQ ID NO: 333828 - protein, 20 aa, Artificial Sequence
  Description of Artificial Sequence: Synthetic peptide
  Seed: PLAHSSSAFTITDQVPFSVS (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXVPFSVS

SEQ ID NO: 333829 - protein, 20 aa, Artificial Sequence
  Description of Artificial Sequence: Synthetic peptide
  Seed: PLAHSSSAFTITDQVPFSVS (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSVS

SEQ ID NO: 333830 - protein, 20 aa, Artificial Sequence
  Description of Artificial Sequence: Synthetic peptide
  Seed: PLAHSSSAFTITDQVPFSVS (PMEL_HUMAN)
  Core: AFTITDQVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSXFTXTXQVXFSVS

SEQ ID NO: 333831 - protein, 20 aa, Artificial Sequence
  Description of Artificial Sequence: Synthetic peptide
  Seed: PLAHSSSAFTITDQVPFSVS (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSVS

SEQ ID NO: 333832 - protein, 20 aa, Artificial Sequence
  Description of Artificial Sequence: Synthetic peptide
  Seed: PLAHSSSAFTITDQVPFSVS (PMEL_HUMAN)
  Core: TITDQVPFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFXITXQXPFXVS

SEQ ID NO: 333833 - protein, 21 aa, Artificial Sequence
  Description of Artificial Sequence: Synthetic peptide
  Seed: PLAHSSSAFTITDQVPFSVSV (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFSVSV

SEQ ID NO: 333834 - protein, 21 aa, Artificial Sequence
  Description of Artificial Sequence: Synthetic peptide
  Seed: PLAHSSSAFTITDQVPFSVSV (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXVPFSVSV

SEQ ID NO: 333835 - protein, 21 aa, Artificial Sequence
  Description of Artificial Sequence: Synthetic peptide
  Seed: PLAHSSSAFTITDQVPFSVSV (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSVSV

SEQ ID NO: 333836 - protein, 21 aa, Artificial Sequence
  Description of Artificial Sequence: Synthetic peptide
  Seed: PLAHSSSAFTITDQVPFSVSV (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSVSV

SEQ ID NO: 333837 - protein, 22 aa, Artificial Sequence
  Description of Artificial Sequence: Synthetic peptide
  Seed: PLAHSSSAFTITDQVPFSVSVS (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFSVSVS

SEQ ID NO: 333838 - protein, 22 aa, Artificial Sequence
  Description of Artificial Sequence: Synthetic peptide
  Seed: PLAHSSSAFTITDQVPFSVSVS (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXVPFSVSVS

SEQ ID NO: 333839 - protein, 22 aa, Artificial Sequence
  Description of Artificial Sequence: Synthetic peptide
  Seed: PLAHSSSAFTITDQVPFSVSVS (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSVSVS

SEQ ID NO: 333840 - protein, 22 aa, Artificial Sequence
  Description of Artificial Sequence: Synthetic peptide
  Seed: PLAHSSSAFTITDQVPFSVSVS (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSVSVS

SEQ ID NO: 333841 - protein, 22 aa, Artificial Sequence
  Description of Artificial Sequence: Synthetic peptide
  Seed: PLAHSSSAFTITDQVPFSVSVS (PMEL_HUMAN)
  Core: ITDQVPFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTXTDXVXFSXSVS

SEQ ID NO: 333842 - protein, 23 aa, Artificial Sequence
  Description of Artificial Sequence: Synthetic peptide
  Seed: PLAHSSSAFTITDQVPFSVSVSQ (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFSVSVSQ

SEQ ID NO: 333843 - protein, 23 aa, Artificial Sequence
  Description of Artificial Sequence: Synthetic peptide
  Seed: PLAHSSSAFTITDQVPFSVSVSQ (PMEL_HUMAN)
  Core: SSAFTITDQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSXSAXTXTDXVPFSVSVSQ

SEQ ID NO: 333844 - protein, 23 aa, Artificial Sequence
  Description of Artificial Sequence: Synthetic peptide
  Seed: PLAHSSSAFTITDQVPFSVSVSQ (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSVSVSQ

SEQ ID NO: 333845 - protein, 23 aa, Artificial Sequence
  Description of Artificial Sequence: Synthetic peptide
  Seed: PLAHSSSAFTITDQVPFSVSVSQ (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSVSVSQ

SEQ ID NO: 333846 - protein, 23 aa, Artificial Sequence
  Description of Artificial Sequence: Synthetic peptide
  Seed: PLAHSSSAFTITDQVPFSVSVSQ (PMEL_HUMAN)
  Core: ITDQVPFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTXTDXVXFSXSVSQ

SEQ ID NO: 333847 - protein, 23 aa, Artificial Sequence
  Description of Artificial Sequence: Synthetic peptide
  Seed: PLAHSSSAFTITDQVPFSVSVSQ (PMEL_HUMAN)
  Core: QVPFSVSVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTITDXVPXSXSVXQ

SEQ ID NO: 333848 - protein, 24 aa, Artificial Sequence
  Description of Artificial Sequence: Synthetic peptide
  Seed: PLAHSSSAFTITDQVPFSVSVSQL (PMEL_HUMAN)
  Core: AHSSSAFTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXHSXSXFTXTDQVPFSVSVSQL

SEQ ID NO: 333849 - protein, 24 aa, Artificial Sequence
  Description of Artificial Sequence: Synthetic peptide
  Seed: PLAHSSSAFTITDQVPFSVSVSQL (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSVSVSQL

SEQ ID NO: 333850 - protein, 24 aa, Artificial Sequence
  Description of Artificial Sequence: Synthetic peptide
  Seed: PLAHSSSAFTITDQVPFSVSVSQL (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSVSVSQL

SEQ ID NO: 333851 - protein, 24 aa, Artificial Sequence
  Description of Artificial Sequence: Synthetic peptide
  Seed: PLAHSSSAFTITDQVPFSVSVSQL (PMEL_HUMAN)
  Core: ITDQVPFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTXTDXVXFSXSVSQL

SEQ ID NO: 333852 - protein, 24 aa, Artificial Sequence
  Description of Artificial Sequence: Synthetic peptide
  Seed: PLAHSSSAFTITDQVPFSVSVSQL (PMEL_HUMAN)
  Core: QVPFSVSVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTITDXVPXSXSVXQL

SEQ ID NO: 333853 - protein, 25 aa, Artificial Sequence
  Description of Artificial Sequence: Synthetic peptide
  Seed: PLAHSSSAFTITDQVPFSVSVSQLR (PMEL_HUMAN)
  Core: SAFTITDQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSXAFXIXDQXPFSVSVSQLR

SEQ ID NO: 333854 - protein, 25 aa, Artificial Sequence
  Description of Artificial Sequence: Synthetic peptide
  Seed: PLAHSSSAFTITDQVPFSVSVSQLR (PMEL_HUMAN)
  Core: FTITDQVPF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAXTIXDXVPXSVSVSQLR

SEQ ID NO: 333855 - protein, 25 aa, Artificial Sequence
  Description of Artificial Sequence: Synthetic peptide
  Seed: PLAHSSSAFTITDQVPFSVSVSQLR (PMEL_HUMAN)
  Core: ITDQVPFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTXTDXVXFSXSVSQLR

SEQ ID NO: 333856 - protein, 25 aa, Artificial Sequence
  Description of Artificial Sequence: Synthetic peptide
  Seed: PLAHSSSAFTITDQVPFSVSVSQLR (PMEL_HUMAN)
  Core: QVPFSVSVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTITDXVPXSXSVXQLR

SEQ ID NO: 333857 - protein, 25 aa, Artificial Sequence
  Description of Artificial Sequence: Synthetic peptide
  Seed: PLAHSSSAFTITDQVPFSVSVSQLR (PMEL_HUMAN)
  Core: PFSVSVSQL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PLAHSSSAFTITDQVXFSXSXSQXR

SEQ ID NO: 333858 - protein, 14 aa, Artificial Sequence
  Description of Artificial Sequence: Synthetic peptide
  Seed: PLDCVLYRYGSFSV (PMEL_HUMAN)
  Core: LDCVLYRYG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXDCXLXRYXSFSV

SEQ ID NO: 333859 - protein, 14 aa, Artificial Sequence
  Description of Artificial Sequence: Synthetic peptide
  Seed: PLDCVLYRYGSFSV (PMEL_HUMAN)
  Core: CVLYRYGSF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLDXVLXRXGSXSV

SEQ ID NO: 333860 - protein, 14 aa, Artificial Sequence
  Description of Artificial Sequence: Synthetic peptide
  Seed: PLDCVLYRYGSFSV (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSX

SEQ ID NO: 333861 - protein, 15 aa, Artificial Sequence
  Description of Artificial Sequence: Synthetic peptide
  Seed: PLDCVLYRYGSFSVT (PMEL_HUMAN)
  Core: CVLYRYGSF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLDXVLXRXGSXSVT

SEQ ID NO: 333862 - protein, 15 aa, Artificial Sequence
  Description of Artificial Sequence: Synthetic peptide
  Seed: PLDCVLYRYGSFSVT (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXT

SEQ ID NO: 333863 - protein, 15 aa, Artificial Sequence
  Description of Artificial Sequence: Synthetic peptide
  Seed: PLDCVLYRYGSFSVT (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVX

SEQ ID NO: 333864 - protein, 16 aa, Artificial Sequence
  Description of Artificial Sequence: Synthetic peptide
  Seed: PLDCVLYRYGSFSVTL (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTL

SEQ ID NO: 333865 - protein, 16 aa, Artificial Sequence
  Description of Artificial Sequence: Synthetic peptide
  Seed: PLDCVLYRYGSFSVTL (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXL

SEQ ID NO: 333866 - protein, 16 aa, Artificial Sequence
  Description of Artificial Sequence: Synthetic peptide
  Seed: PLDCVLYRYGSFSVTL (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTX

SEQ ID NO: 333867 - protein, 17 aa, Artificial Sequence
  Description of Artificial Sequence: Synthetic peptide
  Seed: PLDCVLYRYGSFSVTLD (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLD

SEQ ID NO: 333868 - protein, 17 aa, Artificial Sequence
  Description of Artificial Sequence: Synthetic peptide
  Seed: PLDCVLYRYGSFSVTLD (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLD

SEQ ID NO: 333869 - protein, 17 aa, Artificial Sequence
  Description of Artificial Sequence: Synthetic peptide
  Seed: PLDCVLYRYGSFSVTLD (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXD

SEQ ID NO: 333870 - protein, 17 aa, Artificial Sequence
  Description of Artificial Sequence: Synthetic peptide
  Seed: PLDCVLYRYGSFSVTLD (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLX

SEQ ID NO: 333871 - protein, 18 aa, Artificial Sequence
  Description of Artificial Sequence: Synthetic peptide
  Seed: PLDCVLYRYGSFSVTLDI (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDI

SEQ ID NO: 333872 - protein, 18 aa, Artificial Sequence
  Description of Artificial Sequence: Synthetic peptide
  Seed: PLDCVLYRYGSFSVTLDI (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDI

SEQ ID NO: 333873 - protein, 18 aa, Artificial Sequence
  Description of Artificial Sequence: Synthetic peptide
  Seed: PLDCVLYRYGSFSVTLDI (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDI

SEQ ID NO: 333874 - protein, 18 aa, Artificial Sequence
  Description of Artificial Sequence: Synthetic peptide
  Seed: PLDCVLYRYGSFSVTLDI (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXI

SEQ ID NO: 333875 - protein, 19 aa, Artificial Sequence
  Description of Artificial Sequence: Synthetic peptide
  Seed: PLDCVLYRYGSFSVTLDIV (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIV

SEQ ID NO: 333876 - protein, 19 aa, Artificial Sequence
  Description of Artificial Sequence: Synthetic peptide
  Seed: PLDCVLYRYGSFSVTLDIV (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIV

SEQ ID NO: 333877 - protein, 19 aa, Artificial Sequence
  Description of Artificial Sequence: Synthetic peptide
  Seed: PLDCVLYRYGSFSVTLDIV (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIV

SEQ ID NO: 333878 - protein, 19 aa, Artificial Sequence
  Description of Artificial Sequence: Synthetic peptide
  Seed: PLDCVLYRYGSFSVTLDIV (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIV

SEQ ID NO: 333879 - protein, 20 aa, Artificial Sequence
  Description of Artificial Sequence: Synthetic peptide
  Seed: PLDCVLYRYGSFSVTLDIVQ (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIVQ

SEQ ID NO: 333880 - protein, 20 aa, Artificial Sequence
  Description of Artificial Sequence: Synthetic peptide
  Seed: PLDCVLYRYGSFSVTLDIVQ (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIVQ

SEQ ID NO: 333881 - protein, 20 aa, Artificial Sequence
  Description of Artificial Sequence: Synthetic peptide
  Seed: PLDCVLYRYGSFSVTLDIVQ (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIVQ

SEQ ID NO: 333882 - protein, 20 aa, Artificial Sequence
  Description of Artificial Sequence: Synthetic peptide
  Seed: PLDCVLYRYGSFSVTLDIVQ (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIVQ

SEQ ID NO: 333883 - protein, 20 aa, Artificial Sequence
  Description of Artificial Sequence: Synthetic peptide
  Seed: PLDCVLYRYGSFSVTLDIVQ (PMEL_HUMAN)
  Core: SFSVTLDIV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGXFSXTXDIXQ

SEQ ID NO: 333884 - protein, 21 aa, Artificial Sequence
  Description of Artificial Sequence: Synthetic peptide
  Seed: PLDCVLYRYGSFSVTLDIVQG (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIVQG

SEQ ID NO: 333885 - protein, 21 aa, Artificial Sequence
  Description of Artificial Sequence: Synthetic peptide
  Seed: PLDCVLYRYGSFSVTLDIVQG (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIVQG

SEQ ID NO: 333886 - protein, 21 aa, Artificial Sequence
  Description of Artificial Sequence: Synthetic peptide
  Seed: PLDCVLYRYGSFSVTLDIVQG (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIVQG

SEQ ID NO: 333887 - protein, 21 aa, Artificial Sequence
  Description of Artificial Sequence: Synthetic peptide
  Seed: PLDCVLYRYGSFSVTLDIVQG (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIVQG

SEQ ID NO: 333888 - protein, 21 aa, Artificial Sequence
  Description of Artificial Sequence: Synthetic peptide
  Seed: PLDCVLYRYGSFSVTLDIVQG (PMEL_HUMAN)
  Core: SFSVTLDIV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGXFSXTXDIXQG

SEQ ID NO: 333889 - protein, 22 aa, Artificial Sequence
  Description of Artificial Sequence: Synthetic peptide
  Seed: PLDCVLYRYGSFSVTLDIVQGI (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIVQGI

SEQ ID NO: 333890 - protein, 22 aa, Artificial Sequence
  Description of Artificial Sequence: Synthetic peptide
  Seed: PLDCVLYRYGSFSVTLDIVQGI (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIVQGI

SEQ ID NO: 333891 - protein, 22 aa, Artificial Sequence
  Description of Artificial Sequence: Synthetic peptide
  Seed: PLDCVLYRYGSFSVTLDIVQGI (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIVQGI

SEQ ID NO: 333892 - protein, 22 aa, Artificial Sequence
  Description of Artificial Sequence: Synthetic peptide
  Seed: PLDCVLYRYGSFSVTLDIVQGI (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIVQGI

SEQ ID NO: 333893 - protein, 22 aa, Artificial Sequence
  Description of Artificial Sequence: Synthetic peptide
  Seed: PLDCVLYRYGSFSVTLDIVQGI (PMEL_HUMAN)
  Core: SFSVTLDIV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGXFSXTXDIXQGI

SEQ ID NO: 333894 - protein, 23 aa, Artificial Sequence
  Description of Artificial Sequence: Synthetic peptide
  Seed: PLDCVLYRYGSFSVTLDIVQGIE (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIVQGIE

SEQ ID NO: 333895 - protein, 23 aa, Artificial Sequence
  Description of Artificial Sequence: Synthetic peptide
  Seed: PLDCVLYRYGSFSVTLDIVQGIE (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIVQGIE

SEQ ID NO: 333896 - protein, 23 aa, Artificial Sequence
  Description of Artificial Sequence: Synthetic peptide
  Seed: PLDCVLYRYGSFSVTLDIVQGIE (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIVQGIE

SEQ ID NO: 333897 - protein, 23 aa, Artificial Sequence
  Description of Artificial Sequence: Synthetic peptide
  Seed: PLDCVLYRYGSFSVTLDIVQGIE (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIVQGIE

SEQ ID NO: 333898 - protein, 23 aa, Artificial Sequence
  Description of Artificial Sequence: Synthetic peptide
  Seed: PLDCVLYRYGSFSVTLDIVQGIE (PMEL_HUMAN)
  Core: FSVTLDIVQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGSXSVXLXIVXGIE

SEQ ID NO: 333899 - protein, 23 aa, Artificial Sequence
  Description of Artificial Sequence: Synthetic peptide
  Seed: PLDCVLYRYGSFSVTLDIVQGIE (PMEL_HUMAN)
  Core: VTLDIVQGI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGSFSXTLXIXQGXE

SEQ ID NO: 333900 - protein, 24 aa, Artificial Sequence
  Description of Artificial Sequence: Synthetic peptide
  Seed: PLDCVLYRYGSFSVTLDIVQGIES (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIVQGIES

SEQ ID NO: 333901 - protein, 24 aa, Artificial Sequence
  Description of Artificial Sequence: Synthetic peptide
  Seed: PLDCVLYRYGSFSVTLDIVQGIES (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIVQGIES

SEQ ID NO: 333902 - protein, 24 aa, Artificial Sequence
  Description of Artificial Sequence: Synthetic peptide
  Seed: PLDCVLYRYGSFSVTLDIVQGIES (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIVQGIES

SEQ ID NO: 333903 - protein, 24 aa, Artificial Sequence
  Description of Artificial Sequence: Synthetic peptide
  Seed: PLDCVLYRYGSFSVTLDIVQGIES (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIVQGIES

SEQ ID NO: 333904 - protein, 24 aa, Artificial Sequence
  Description of Artificial Sequence: Synthetic peptide
  Seed: PLDCVLYRYGSFSVTLDIVQGIES (PMEL_HUMAN)
  Core: FSVTLDIVQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGSXSVXLXIVXGIES

SEQ ID NO: 333905 - protein, 24 aa, Artificial Sequence
  Description of Artificial Sequence: Synthetic peptide
  Seed: PLDCVLYRYGSFSVTLDIVQGIES (PMEL_HUMAN)
  Core: VTLDIVQGI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGSFSXTLXIXQGXES

SEQ ID NO: 333906 - protein, 25 aa, Artificial Sequence
  Description of Artificial Sequence: Synthetic peptide
  Seed: PLDCVLYRYGSFSVTLDIVQGIESA (PMEL_HUMAN)
  Core: LYRYGSFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVXYRXGXFSXTLDIVQGIESA

SEQ ID NO: 333907 - protein, 25 aa, Artificial Sequence
  Description of Artificial Sequence: Synthetic peptide
  Seed: PLDCVLYRYGSFSVTLDIVQGIESA (PMEL_HUMAN)
  Core: YRYGSFSVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLXRYXSXSVXLDIVQGIESA

SEQ ID NO: 333908 - protein, 25 aa, Artificial Sequence
  Description of Artificial Sequence: Synthetic peptide
  Seed: PLDCVLYRYGSFSVTLDIVQGIESA (PMEL_HUMAN)
  Core: RYGSFSVTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYXYGXFXVTXDIVQGIESA

SEQ ID NO: 333909 - protein, 25 aa, Artificial Sequence
  Description of Artificial Sequence: Synthetic peptide
  Seed: PLDCVLYRYGSFSVTLDIVQGIESA (PMEL_HUMAN)
  Core: YGSFSVTLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRXGSXSXTLXIVQGIESA

SEQ ID NO: 333910 - protein, 25 aa, Artificial Sequence
  Description of Artificial Sequence: Synthetic peptide
  Seed: PLDCVLYRYGSFSVTLDIVQGIESA (PMEL_HUMAN)
  Core: FSVTLDIVQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGSXSVXLXIVXGIESA

SEQ ID NO: 333911 - protein, 25 aa, Artificial Sequence
  Description of Artificial Sequence: Synthetic peptide
  Seed: PLDCVLYRYGSFSVTLDIVQGIESA (PMEL_HUMAN)
  Core: VTLDIVQGI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLDCVLYRYGSFSXTLXIXQGXESA

SEQ ID NO: 333912 - protein, 14 aa, Artificial Sequence
  Description of Artificial Sequence: Synthetic peptide
  Seed: PLIVGILLVLMAVV (PMEL_HUMAN)
  Core: IVGILLVLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXVGXLXVLXAVV

SEQ ID NO: 333913 - protein, 15 aa, Artificial Sequence
  Description of Artificial Sequence: Synthetic peptide
  Seed: PLIVGILLVLMAVVL (PMEL_HUMAN)
  Core: IVGILLVLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXVGXLXVLXAVVL

SEQ ID NO: 333914 - protein, 15 aa, Artificial Sequence
  Description of Artificial Sequence: Synthetic peptide
  Seed: PLIVGILLVLMAVVL (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXL

SEQ ID NO: 333915 - protein, 16 aa, Artificial Sequence
  Description of Artificial Sequence: Synthetic peptide
  Seed: PLIVGILLVLMAVVLA (PMEL_HUMAN)
  Core: IVGILLVLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXVGXLXVLXAVVLA

SEQ ID NO: 333916 - protein, 16 aa, Artificial Sequence
  Description of Artificial Sequence: Synthetic peptide
  Seed: PLIVGILLVLMAVVLA (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLA

SEQ ID NO: 333917 - protein, 16 aa, Artificial Sequence
  Description of Artificial Sequence: Synthetic peptide
  Seed: PLIVGILLVLMAVVLA (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXA

SEQ ID NO: 333918 - protein, 17 aa, Artificial Sequence
  Description of Artificial Sequence: Synthetic peptide
  Seed: PLIVGILLVLMAVVLAS (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLAS

SEQ ID NO: 333919 - protein, 17 aa, Artificial Sequence
  Description of Artificial Sequence: Synthetic peptide
  Seed: PLIVGILLVLMAVVLAS (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXAS

SEQ ID NO: 333920 - protein, 17 aa, Artificial Sequence
  Description of Artificial Sequence: Synthetic peptide
  Seed: PLIVGILLVLMAVVLAS (PMEL_HUMAN)
  Core: LVLMAVVLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILXVLXAXVLXS

SEQ ID NO: 333921 - protein, 18 aa, Artificial Sequence
  Description of Artificial Sequence: Synthetic peptide
  Seed: PLIVGILLVLMAVVLASL (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLASL

SEQ ID NO: 333922 - protein, 18 aa, Artificial Sequence
  Description of Artificial Sequence: Synthetic peptide
  Seed: PLIVGILLVLMAVVLASL (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASL

SEQ ID NO: 333923 - protein, 19 aa, Artificial Sequence
  Description of Artificial Sequence: Synthetic peptide
  Seed: PLIVGILLVLMAVVLASLI (PMEL_HUMAN)
  Core: IVGILLVLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXVGXLXVLXAVVLASLI

SEQ ID NO: 333924 - protein, 19 aa, Artificial Sequence
  Description of Artificial Sequence: Synthetic peptide
  Seed: PLIVGILLVLMAVVLASLI (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLASLI

SEQ ID NO: 333925 - protein, 19 aa, Artificial Sequence
  Description of Artificial Sequence: Synthetic peptide
  Seed: PLIVGILLVLMAVVLASLI (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLI

SEQ ID NO: 333926 - protein, 19 aa, Artificial Sequence
  Description of Artificial Sequence: Synthetic peptide
  Seed: PLIVGILLVLMAVVLASLI (PMEL_HUMAN)
  Core: VLMAVVLAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLXLMXVXLAXLI

SEQ ID NO: 333927 - protein, 20 aa, Artificial Sequence
  Description of Artificial Sequence: Synthetic peptide
  Seed: PLIVGILLVLMAVVLASLIY (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLASLIY

SEQ ID NO: 333928 - protein, 20 aa, Artificial Sequence
  Description of Artificial Sequence: Synthetic peptide
  Seed: PLIVGILLVLMAVVLASLIY (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLIY

SEQ ID NO: 333929 - protein, 20 aa, Artificial Sequence
  Description of Artificial Sequence: Synthetic peptide
  Seed: PLIVGILLVLMAVVLASLIY (PMEL_HUMAN)
  Core: LVLMAVVLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILXVLXAXVLXSLIY

SEQ ID NO: 333930 - protein, 20 aa, Artificial Sequence
  Description of Artificial Sequence: Synthetic peptide
  Seed: PLIVGILLVLMAVVLASLIY (PMEL_HUMAN)
  Core: VLMAVVLAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLXLMXVXLAXLIY

SEQ ID NO: 333931 - protein, 20 aa, Artificial Sequence
  Description of Artificial Sequence: Synthetic peptide
  Seed: PLIVGILLVLMAVVLASLIY (PMEL_HUMAN)
  Core: LMAVVLASL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVXMAXVXASXIY

SEQ ID NO: 333932 - protein, 21 aa, Artificial Sequence
  Description of Artificial Sequence: Synthetic peptide
  Seed: PLIVGILLVLMAVVLASLIYR (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLASLIYR

SEQ ID NO: 333933 - protein, 21 aa, Artificial Sequence
  Description of Artificial Sequence: Synthetic peptide
  Seed: PLIVGILLVLMAVVLASLIYR (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLIYR

SEQ ID NO: 333934 - protein, 21 aa, Artificial Sequence
  Description of Artificial Sequence: Synthetic peptide
  Seed: PLIVGILLVLMAVVLASLIYR (PMEL_HUMAN)
  Core: LVLMAVVLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILXVLXAXVLXSLIYR

SEQ ID NO: 333935 - protein, 21 aa, Artificial Sequence
  Description of Artificial Sequence: Synthetic peptide
  Seed: PLIVGILLVLMAVVLASLIYR (PMEL_HUMAN)
  Core: LMAVVLASL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVXMAXVXASXIYR

SEQ ID NO: 333936 - protein, 22 aa, Artificial Sequence
  Description of Artificial Sequence: Synthetic peptide
  Seed: PLIVGILLVLMAVVLASLIYRR (PMEL_HUMAN)
  Core: ILLVLMAVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGXLLXLXAVXLASLIYRR

SEQ ID NO: 333937 - protein, 22 aa, Artificial Sequence
  Description of Artificial Sequence: Synthetic peptide
  Seed: PLIVGILLVLMAVVLASLIYRR (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLIYRR

SEQ ID NO: 333938 - protein, 22 aa, Artificial Sequence
  Description of Artificial Sequence: Synthetic peptide
  Seed: PLIVGILLVLMAVVLASLIYRR (PMEL_HUMAN)
  Core: VLMAVVLAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLXLMXVXLAXLIYRR

SEQ ID NO: 333939 - protein, 22 aa, Artificial Sequence
  Description of Artificial Sequence: Synthetic peptide
  Seed: PLIVGILLVLMAVVLASLIYRR (PMEL_HUMAN)
  Core: LMAVVLASL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVXMAXVXASXIYRR

SEQ ID NO: 333940 - protein, 22 aa, Artificial Sequence
  Description of Artificial Sequence: Synthetic peptide
  Seed: PLIVGILLVLMAVVLASLIYRR (PMEL_HUMAN)
  Core: MAVVLASLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLXAVXLXSLXYRR

SEQ ID NO: 333941 - protein, 22 aa, Artificial Sequence
  Description of Artificial Sequence: Synthetic peptide
  Seed: PLIVGILLVLMAVVLASLIYRR (PMEL_HUMAN)
  Core: VVLASLIYR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAXVLXSXIYXR

SEQ ID NO: 333942 - protein, 23 aa, Artificial Sequence
  Description of Artificial Sequence: Synthetic peptide
  Seed: PLIVGILLVLMAVVLASLIYRRR (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLIYRRR

SEQ ID NO: 333943 - protein, 23 aa, Artificial Sequence
  Description of Artificial Sequence: Synthetic peptide
  Seed: PLIVGILLVLMAVVLASLIYRRR (PMEL_HUMAN)
  Core: LVLMAVVLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILXVLXAXVLXSLIYRRR

SEQ ID NO: 333944 - protein, 23 aa, Artificial Sequence
  Description of Artificial Sequence: Synthetic peptide
  Seed: PLIVGILLVLMAVVLASLIYRRR (PMEL_HUMAN)
  Core: VLMAVVLAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLXLMXVXLAXLIYRRR

SEQ ID NO: 333945 - protein, 23 aa, Artificial Sequence
  Description of Artificial Sequence: Synthetic peptide
  Seed: PLIVGILLVLMAVVLASLIYRRR (PMEL_HUMAN)
  Core: MAVVLASLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLXAVXLXSLXYRRR

SEQ ID NO: 333946 - protein, 23 aa, Artificial Sequence
  Description of Artificial Sequence: Synthetic peptide
  Seed: PLIVGILLVLMAVVLASLIYRRR (PMEL_HUMAN)
  Core: AVVLASLIY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMXVVXAXLIXRRR

SEQ ID NO: 333947 - protein, 23 aa, Artificial Sequence
  Description of Artificial Sequence: Synthetic peptide
  Seed: PLIVGILLVLMAVVLASLIYRRR (PMEL_HUMAN)
  Core: VVLASLIYR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAXVLXSXIYXRR

SEQ ID NO: 333948 - protein, 23 aa, Artificial Sequence
  Description of Artificial Sequence: Synthetic peptide
  Seed: PLIVGILLVLMAVVLASLIYRRR (PMEL_HUMAN)
  Core: VLASLIYRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAVXLAXLXYRXR

SEQ ID NO: 333949 - protein, 23 aa, Artificial Sequence
  Description of Artificial Sequence: Synthetic peptide
  Seed: PLIVGILLVLMAVVLASLIYRRR (PMEL_HUMAN)
  Core: LASLIYRRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAVVXASXIXRRX

SEQ ID NO: 333950 - protein, 24 aa, Artificial Sequence
  Description of Artificial Sequence: Synthetic peptide
  Seed: PLIVGILLVLMAVVLASLIYRRRL (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLIYRRRL

SEQ ID NO: 333951 - protein, 24 aa, Artificial Sequence
  Description of Artificial Sequence: Synthetic peptide
  Seed: PLIVGILLVLMAVVLASLIYRRRL (PMEL_HUMAN)
  Core: LVLMAVVLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILXVLXAXVLXSLIYRRRL

SEQ ID NO: 333952 - protein, 24 aa, Artificial Sequence
  Description of Artificial Sequence: Synthetic peptide
  Seed: PLIVGILLVLMAVVLASLIYRRRL (PMEL_HUMAN)
  Core: VLMAVVLAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLXLMXVXLAXLIYRRRL

SEQ ID NO: 333953 - protein, 24 aa, Artificial Sequence
  Description of Artificial Sequence: Synthetic peptide
  Seed: PLIVGILLVLMAVVLASLIYRRRL (PMEL_HUMAN)
  Core: LMAVVLASL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVXMAXVXASXIYRRRL

SEQ ID NO: 333954 - protein, 24 aa, Artificial Sequence
  Description of Artificial Sequence: Synthetic peptide
  Seed: PLIVGILLVLMAVVLASLIYRRRL (PMEL_HUMAN)
  Core: MAVVLASLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLXAVXLXSLXYRRRL

SEQ ID NO: 333955 - protein, 24 aa, Artificial Sequence
  Description of Artificial Sequence: Synthetic peptide
  Seed: PLIVGILLVLMAVVLASLIYRRRL (PMEL_HUMAN)
  Core: AVVLASLIY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMXVVXAXLIXRRRL

SEQ ID NO: 333956 - protein, 24 aa, Artificial Sequence
  Description of Artificial Sequence: Synthetic peptide
  Seed: PLIVGILLVLMAVVLASLIYRRRL (PMEL_HUMAN)
  Core: VVLASLIYR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAXVLXSXIYXRRL

SEQ ID NO: 333957 - protein, 24 aa, Artificial Sequence
  Description of Artificial Sequence: Synthetic peptide
  Seed: PLIVGILLVLMAVVLASLIYRRRL (PMEL_HUMAN)
  Core: VLASLIYRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAVXLAXLXYRXRL

SEQ ID NO: 333958 - protein, 24 aa, Artificial Sequence
  Description of Artificial Sequence: Synthetic peptide
  Seed: PLIVGILLVLMAVVLASLIYRRRL (PMEL_HUMAN)
  Core: LASLIYRRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAVVXASXIXRRXL

SEQ ID NO: 333959 - protein, 25 aa, Artificial Sequence
  Description of Artificial Sequence: Synthetic peptide
  Seed: PLIVGILLVLMAVVLASLIYRRRLM (PMEL_HUMAN)
  Core: LLVLMAVVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGIXLVXMXVVXASLIYRRRLM

SEQ ID NO: 333960 - protein, 25 aa, Artificial Sequence
  Description of Artificial Sequence: Synthetic peptide
  Seed: PLIVGILLVLMAVVLASLIYRRRLM (PMEL_HUMAN)
  Core: LVLMAVVLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILXVLXAXVLXSLIYRRRLM

SEQ ID NO: 333961 - protein, 25 aa, Artificial Sequence
  Description of Artificial Sequence: Synthetic peptide
  Seed: PLIVGILLVLMAVVLASLIYRRRLM (PMEL_HUMAN)
  Core: VLMAVVLAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLXLMXVXLAXLIYRRRLM

SEQ ID NO: 333962 - protein, 25 aa, Artificial Sequence
  Description of Artificial Sequence: Synthetic peptide
  Seed: PLIVGILLVLMAVVLASLIYRRRLM (PMEL_HUMAN)
  Core: LMAVVLASL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVXMAXVXASXIYRRRLM

SEQ ID NO: 333963 - protein, 25 aa, Artificial Sequence
  Description of Artificial Sequence: Synthetic peptide
  Seed: PLIVGILLVLMAVVLASLIYRRRLM (PMEL_HUMAN)
  Core: MAVVLASLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLXAVXLXSLXYRRRLM

SEQ ID NO: 333964 - protein, 25 aa, Artificial Sequence
  Description of Artificial Sequence: Synthetic peptide
  Seed: PLIVGILLVLMAVVLASLIYRRRLM (PMEL_HUMAN)
  Core: AVVLASLIY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMXVVXAXLIXRRRLM

SEQ ID NO: 333965 - protein, 25 aa, Artificial Sequence
  Description of Artificial Sequence: Synthetic peptide
  Seed: PLIVGILLVLMAVVLASLIYRRRLM (PMEL_HUMAN)
  Core: VVLASLIYR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAXVLXSXIYXRRLM

SEQ ID NO: 333966 - protein, 25 aa, Artificial Sequence
  Description of Artificial Sequence: Synthetic peptide
  Seed: PLIVGILLVLMAVVLASLIYRRRLM (PMEL_HUMAN)
  Core: VLASLIYRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAVXLAXLXYRXRLM

SEQ ID NO: 333967 - protein, 25 aa, Artificial Sequence
  Description of Artificial Sequence: Synthetic peptide
  Seed: PLIVGILLVLMAVVLASLIYRRRLM (PMEL_HUMAN)
  Core: LASLIYRRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PLIVGILLVLMAVVXASXIXRRXLM

SEQ ID NO: 333968 - protein, 14 aa, Artificial Sequence
  Description of Artificial Sequence: Synthetic peptide
  Seed: PLLDGTATLRLVKR (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKR

SEQ ID NO: 333969 - protein, 14 aa, Artificial Sequence
  Description of Artificial Sequence: Synthetic peptide
  Seed: PLLDGTATLRLVKR (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKR

SEQ ID NO: 333970 - protein, 15 aa, Artificial Sequence
  Description of Artificial Sequence: Synthetic peptide
  Seed: PLLDGTATLRLVKRQ (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQ

SEQ ID NO: 333971 - protein, 15 aa, Artificial Sequence
  Description of Artificial Sequence: Synthetic peptide
  Seed: PLLDGTATLRLVKRQ (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQ

SEQ ID NO: 333972 - protein, 15 aa, Artificial Sequence
  Description of Artificial Sequence: Synthetic peptide
  Seed: PLLDGTATLRLVKRQ (PMEL_HUMAN)
  Core: GTATLRLVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLLDXTAXLXLVXRQ

SEQ ID NO: 333973 - protein, 16 aa, Artificial Sequence
  Description of Artificial Sequence: Synthetic peptide
  Seed: PLLDGTATLRLVKRQV (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQV

SEQ ID NO: 333974 - protein, 16 aa, Artificial Sequence
  Description of Artificial Sequence: Synthetic peptide
  Seed: PLLDGTATLRLVKRQV (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQV

SEQ ID NO: 333975 - protein, 16 aa, Artificial Sequence
  Description of Artificial Sequence: Synthetic peptide
  Seed: PLLDGTATLRLVKRQV (PMEL_HUMAN)
  Core: GTATLRLVK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLLDXTAXLXLVXRQV

SEQ ID NO: 333976 - protein, 16 aa, Artificial Sequence
  Description of Artificial Sequence: Synthetic peptide
  Seed: PLLDGTATLRLVKRQV (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQV

SEQ ID NO: 333977 - protein, 17 aa, Artificial Sequence
  Description of Artificial Sequence: Synthetic peptide
  Seed: PLLDGTATLRLVKRQVP (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVP

SEQ ID NO: 333978 - protein, 17 aa, Artificial Sequence
  Description of Artificial Sequence: Synthetic peptide
  Seed: PLLDGTATLRLVKRQVP (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVP

SEQ ID NO: 333979 - protein, 17 aa, Artificial Sequence
  Description of Artificial Sequence: Synthetic peptide
  Seed: PLLDGTATLRLVKRQVP (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVP

SEQ ID NO: 333980 - protein, 17 aa, Artificial Sequence
  Description of Artificial Sequence: Synthetic peptide
  Seed: PLLDGTATLRLVKRQVP (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXP

SEQ ID NO: 333981 - protein, 17 aa, Artificial Sequence
  Description of Artificial Sequence: Synthetic peptide
  Seed: PLLDGTATLRLVKRQVP (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVX

SEQ ID NO: 333982 - protein, 18 aa, Artificial Sequence
  Description of Artificial Sequence: Synthetic peptide
  Seed: PLLDGTATLRLVKRQVPL (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPL

SEQ ID NO: 333983 - protein, 18 aa, Artificial Sequence
  Description of Artificial Sequence: Synthetic peptide
  Seed: PLLDGTATLRLVKRQVPL (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPL

SEQ ID NO: 333984 - protein, 18 aa, Artificial Sequence
  Description of Artificial Sequence: Synthetic peptide
  Seed: PLLDGTATLRLVKRQVPL (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXL

SEQ ID NO: 333985 - protein, 19 aa, Artificial Sequence
  Description of Artificial Sequence: Synthetic peptide
  Seed: PLLDGTATLRLVKRQVPLD (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLD

SEQ ID NO: 333986 - protein, 19 aa, Artificial Sequence
  Description of Artificial Sequence: Synthetic peptide
  Seed: PLLDGTATLRLVKRQVPLD (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLD

SEQ ID NO: 333987 - protein, 19 aa, Artificial Sequence
  Description of Artificial Sequence: Synthetic peptide
  Seed: PLLDGTATLRLVKRQVPLD (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLD

SEQ ID NO: 333988 - protein, 19 aa, Artificial Sequence
  Description of Artificial Sequence: Synthetic peptide
  Seed: PLLDGTATLRLVKRQVPLD (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLD

SEQ ID NO: 333989 - protein, 19 aa, Artificial Sequence
  Description of Artificial Sequence: Synthetic peptide
  Seed: PLLDGTATLRLVKRQVPLD (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLD

SEQ ID NO: 333990 - protein, 20 aa, Artificial Sequence
  Description of Artificial Sequence: Synthetic peptide
  Seed: PLLDGTATLRLVKRQVPLDC (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLDC

SEQ ID NO: 333991 - protein, 20 aa, Artificial Sequence
  Description of Artificial Sequence: Synthetic peptide
  Seed: PLLDGTATLRLVKRQVPLDC (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLDC

SEQ ID NO: 333992 - protein, 20 aa, Artificial Sequence
  Description of Artificial Sequence: Synthetic peptide
  Seed: PLLDGTATLRLVKRQVPLDC (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLDC

SEQ ID NO: 333993 - protein, 20 aa, Artificial Sequence
  Description of Artificial Sequence: Synthetic peptide
  Seed: PLLDGTATLRLVKRQVPLDC (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLDC

SEQ ID NO: 333994 - protein, 20 aa, Artificial Sequence
  Description of Artificial Sequence: Synthetic peptide
  Seed: PLLDGTATLRLVKRQVPLDC (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLDC

SEQ ID NO: 333995 - protein, 21 aa, Artificial Sequence
  Description of Artificial Sequence: Synthetic peptide
  Seed: PLLDGTATLRLVKRQVPLDCV (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLDCV

SEQ ID NO: 333996 - protein, 21 aa, Artificial Sequence
  Description of Artificial Sequence: Synthetic peptide
  Seed: PLLDGTATLRLVKRQVPLDCV (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLDCV

SEQ ID NO: 333997 - protein, 21 aa, Artificial Sequence
  Description of Artificial Sequence: Synthetic peptide
  Seed: PLLDGTATLRLVKRQVPLDCV (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLDCV

SEQ ID NO: 333998 - protein, 21 aa, Artificial Sequence
  Description of Artificial Sequence: Synthetic peptide
  Seed: PLLDGTATLRLVKRQVPLDCV (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLDCV

SEQ ID NO: 333999 - protein, 21 aa, Artificial Sequence
  Description of Artificial Sequence: Synthetic peptide
  Seed: PLLDGTATLRLVKRQVPLDCV (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLDCV

SEQ ID NO: 334000 - protein, 21 aa, Artificial Sequence
  Description of Artificial Sequence: Synthetic peptide
  Seed: PLLDGTATLRLVKRQVPLDCV (PMEL_HUMAN)
  Core: LVKRQVPLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRXVKXQXPLXCV

SEQ ID NO: 334001 - protein, 22 aa, Artificial Sequence
  Description of Artificial Sequence: Synthetic peptide
  Seed: PLLDGTATLRLVKRQVPLDCVL (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLDCVL

SEQ ID NO: 334002 - protein, 22 aa, Artificial Sequence
  Description of Artificial Sequence: Synthetic peptide
  Seed: PLLDGTATLRLVKRQVPLDCVL (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLDCVL

SEQ ID NO: 334003 - protein, 22 aa, Artificial Sequence
  Description of Artificial Sequence: Synthetic peptide
  Seed: PLLDGTATLRLVKRQVPLDCVL (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLDCVL

SEQ ID NO: 334004 - protein, 22 aa, Artificial Sequence
  Description of Artificial Sequence: Synthetic peptide
  Seed: PLLDGTATLRLVKRQVPLDCVL (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLDCVL

SEQ ID NO: 334005 - protein, 22 aa, Artificial Sequence
  Description of Artificial Sequence: Synthetic peptide
  Seed: PLLDGTATLRLVKRQVPLDCVL (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLDCVL

SEQ ID NO: 334006 - protein, 22 aa, Artificial Sequence
  Description of Artificial Sequence: Synthetic peptide
  Seed: PLLDGTATLRLVKRQVPLDCVL (PMEL_HUMAN)
  Core: LVKRQVPLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRXVKXQXPLXCVL

SEQ ID NO: 334007 - protein, 23 aa, Artificial Sequence
  Description of Artificial Sequence: Synthetic peptide
  Seed: PLLDGTATLRLVKRQVPLDCVLY (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLDCVLY

SEQ ID NO: 334008 - protein, 23 aa, Artificial Sequence
  Description of Artificial Sequence: Synthetic peptide
  Seed: PLLDGTATLRLVKRQVPLDCVLY (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLDCVLY

SEQ ID NO: 334009 - protein, 23 aa, Artificial Sequence
  Description of Artificial Sequence: Synthetic peptide
  Seed: PLLDGTATLRLVKRQVPLDCVLY (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLDCVLY

SEQ ID NO: 334010 - protein, 23 aa, Artificial Sequence
  Description of Artificial Sequence: Synthetic peptide
  Seed: PLLDGTATLRLVKRQVPLDCVLY (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLDCVLY

SEQ ID NO: 334011 - protein, 23 aa, Artificial Sequence
  Description of Artificial Sequence: Synthetic peptide
  Seed: PLLDGTATLRLVKRQVPLDCVLY (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLDCVLY

SEQ ID NO: 334012 - protein, 23 aa, Artificial Sequence
  Description of Artificial Sequence: Synthetic peptide
  Seed: PLLDGTATLRLVKRQVPLDCVLY (PMEL_HUMAN)
  Core: RLVKRQVPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLXLVXRXVPXDCVLY

SEQ ID NO: 334013 - protein, 23 aa, Artificial Sequence
  Description of Artificial Sequence: Synthetic peptide
  Seed: PLLDGTATLRLVKRQVPLDCVLY (PMEL_HUMAN)
  Core: LVKRQVPLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRXVKXQXPLXCVLY

SEQ ID NO: 334014 - protein, 23 aa, Artificial Sequence
  Description of Artificial Sequence: Synthetic peptide
  Seed: PLLDGTATLRLVKRQVPLDCVLY (PMEL_HUMAN)
  Core: VKRQVPLDC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRLXKRXVXLDXVLY

SEQ ID NO: 334015 - protein, 24 aa, Artificial Sequence
  Description of Artificial Sequence: Synthetic peptide
  Seed: PLLDGTATLRLVKRQVPLDCVLYR (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLDCVLYR

SEQ ID NO: 334016 - protein, 24 aa, Artificial Sequence
  Description of Artificial Sequence: Synthetic peptide
  Seed: PLLDGTATLRLVKRQVPLDCVLYR (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLDCVLYR

SEQ ID NO: 334017 - protein, 24 aa, Artificial Sequence
  Description of Artificial Sequence: Synthetic peptide
  Seed: PLLDGTATLRLVKRQVPLDCVLYR (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLDCVLYR

SEQ ID NO: 334018 - protein, 24 aa, Artificial Sequence
  Description of Artificial Sequence: Synthetic peptide
  Seed: PLLDGTATLRLVKRQVPLDCVLYR (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLDCVLYR

SEQ ID NO: 334019 - protein, 24 aa, Artificial Sequence
  Description of Artificial Sequence: Synthetic peptide
  Seed: PLLDGTATLRLVKRQVPLDCVLYR (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLDCVLYR

SEQ ID NO: 334020 - protein, 24 aa, Artificial Sequence
  Description of Artificial Sequence: Synthetic peptide
  Seed: PLLDGTATLRLVKRQVPLDCVLYR (PMEL_HUMAN)
  Core: RLVKRQVPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLXLVXRXVPXDCVLYR

SEQ ID NO: 334021 - protein, 24 aa, Artificial Sequence
  Description of Artificial Sequence: Synthetic peptide
  Seed: PLLDGTATLRLVKRQVPLDCVLYR (PMEL_HUMAN)
  Core: LVKRQVPLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRXVKXQXPLXCVLYR

SEQ ID NO: 334022 - protein, 24 aa, Artificial Sequence
  Description of Artificial Sequence: Synthetic peptide
  Seed: PLLDGTATLRLVKRQVPLDCVLYR (PMEL_HUMAN)
  Core: VKRQVPLDC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRLXKRXVXLDXVLYR

SEQ ID NO: 334023 - protein, 24 aa, Artificial Sequence
  Description of Artificial Sequence: Synthetic peptide
  Seed: PLLDGTATLRLVKRQVPLDCVLYR (PMEL_HUMAN)
  Core: KRQVPLDCV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRLVXRQXPXDCXLYR

SEQ ID NO: 334024 - protein, 25 aa, Artificial Sequence
  Description of Artificial Sequence: Synthetic peptide
  Seed: PLLDGTATLRLVKRQVPLDCVLYRY (PMEL_HUMAN)
  Core: LDGTATLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PLXDGXAXLRXVKRQVPLDCVLYRY

SEQ ID NO: 334025 - protein, 25 aa, Artificial Sequence
  Description of Artificial Sequence: Synthetic peptide
  Seed: PLLDGTATLRLVKRQVPLDCVLYRY (PMEL_HUMAN)
  Core: DGTATLRLV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLLXGTXTXRLXKRQVPLDCVLYRY

SEQ ID NO: 334026 - protein, 25 aa, Artificial Sequence
  Description of Artificial Sequence: Synthetic peptide
  Seed: PLLDGTATLRLVKRQVPLDCVLYRY (PMEL_HUMAN)
  Core: TATLRLVKR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGXATXRXVKXQVPLDCVLYRY

SEQ ID NO: 334027 - protein, 25 aa, Artificial Sequence
  Description of Artificial Sequence: Synthetic peptide
  Seed: PLLDGTATLRLVKRQVPLDCVLYRY (PMEL_HUMAN)
  Core: TLRLVKRQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTAXLRXVXRQXPLDCVLYRY

SEQ ID NO: 334028 - protein, 25 aa, Artificial Sequence
  Description of Artificial Sequence: Synthetic peptide
  Seed: PLLDGTATLRLVKRQVPLDCVLYRY (PMEL_HUMAN)
  Core: LRLVKRQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATXRLXKXQVXLDCVLYRY

SEQ ID NO: 334029 - protein, 25 aa, Artificial Sequence
  Description of Artificial Sequence: Synthetic peptide
  Seed: PLLDGTATLRLVKRQVPLDCVLYRY (PMEL_HUMAN)
  Core: RLVKRQVPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLXLVXRXVPXDCVLYRY

SEQ ID NO: 334030 - protein, 25 aa, Artificial Sequence
  Description of Artificial Sequence: Synthetic peptide
  Seed: PLLDGTATLRLVKRQVPLDCVLYRY (PMEL_HUMAN)
  Core: LVKRQVPLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRXVKXQXPLXCVLYRY

SEQ ID NO: 334031 - protein, 25 aa, Artificial Sequence
  Description of Artificial Sequence: Synthetic peptide
  Seed: PLLDGTATLRLVKRQVPLDCVLYRY (PMEL_HUMAN)
  Core: VKRQVPLDC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRLXKRXVXLDXVLYRY

SEQ ID NO: 334032 - protein, 25 aa, Artificial Sequence
  Description of Artificial Sequence: Synthetic peptide
  Seed: PLLDGTATLRLVKRQVPLDCVLYRY (PMEL_HUMAN)
  Core: KRQVPLDCV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRLVXRQXPXDCXLYRY

SEQ ID NO: 334033 - protein, 25 aa, Artificial Sequence
  Description of Artificial Sequence: Synthetic peptide
  Seed: PLLDGTATLRLVKRQVPLDCVLYRY (PMEL_HUMAN)
  Core: VPLDCVLYR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PLLDGTATLRLVKRQXPLXCXLYXY

SEQ ID NO: 334034 - protein, 14 aa, Artificial Sequence
  Description of Artificial Sequence: Synthetic peptide
  Seed: PLTFALQLHDPSGY (PMEL_HUMAN)
  Core: LTFALQLHD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXTFXLXLHXPSGY

SEQ ID NO: 334035 - protein, 14 aa, Artificial Sequence
  Description of Artificial Sequence: Synthetic peptide
  Seed: PLTFALQLHDPSGY (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGY

SEQ ID NO: 334036 - protein, 14 aa, Artificial Sequence
  Description of Artificial Sequence: Synthetic peptide
  Seed: PLTFALQLHDPSGY (PMEL_HUMAN)
  Core: ALQLHDPSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLTFXLQXHXPSXY

SEQ ID NO: 334037 - protein, 15 aa, Artificial Sequence
  Description of Artificial Sequence: Synthetic peptide
  Seed: PLTFALQLHDPSGYL (PMEL_HUMAN)
  Core: LTFALQLHD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXTFXLXLHXPSGYL

SEQ ID NO: 334038 - protein, 15 aa, Artificial Sequence
  Description of Artificial Sequence: Synthetic peptide
  Seed: PLTFALQLHDPSGYL (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYL

SEQ ID NO: 334039 - protein, 15 aa, Artificial Sequence
  Description of Artificial Sequence: Synthetic peptide
  Seed: PLTFALQLHDPSGYL (PMEL_HUMAN)
  Core: ALQLHDPSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLTFXLQXHXPSXYL

SEQ ID NO: 334040 - protein, 15 aa, Artificial Sequence
  Description of Artificial Sequence: Synthetic peptide
  Seed: PLTFALQLHDPSGYL (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXL

SEQ ID NO: 334041 - protein, 16 aa, Artificial Sequence
  Description of Artificial Sequence: Synthetic peptide
  Seed: PLTFALQLHDPSGYLA (PMEL_HUMAN)
  Core: LTFALQLHD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXTFXLXLHXPSGYLA

SEQ ID NO: 334042 - protein, 16 aa, Artificial Sequence
  Description of Artificial Sequence: Synthetic peptide
  Seed: PLTFALQLHDPSGYLA (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYLA

SEQ ID NO: 334043 - protein, 16 aa, Artificial Sequence
  Description of Artificial Sequence: Synthetic peptide
  Seed: PLTFALQLHDPSGYLA (PMEL_HUMAN)
  Core: ALQLHDPSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLTFXLQXHXPSXYLA

SEQ ID NO: 334044 - protein, 16 aa, Artificial Sequence
  Description of Artificial Sequence: Synthetic peptide
  Seed: PLTFALQLHDPSGYLA (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLA

SEQ ID NO: 334045 - protein, 17 aa, Artificial Sequence
  Description of Artificial Sequence: Synthetic peptide
  Seed: PLTFALQLHDPSGYLAE (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYLAE

SEQ ID NO: 334046 - protein, 17 aa, Artificial Sequence
  Description of Artificial Sequence: Synthetic peptide
  Seed: PLTFALQLHDPSGYLAE (PMEL_HUMAN)
  Core: ALQLHDPSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLTFXLQXHXPSXYLAE

SEQ ID NO: 334047 - protein, 17 aa, Artificial Sequence
  Description of Artificial Sequence: Synthetic peptide
  Seed: PLTFALQLHDPSGYLAE (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAE

SEQ ID NO: 334048 - protein, 18 aa, Artificial Sequence
  Description of Artificial Sequence: Synthetic peptide
  Seed: PLTFALQLHDPSGYLAEA (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEA

SEQ ID NO: 334049 - protein, 19 aa, Artificial Sequence
  Description of Artificial Sequence: Synthetic peptide
  Seed: PLTFALQLHDPSGYLAEAD (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYLAEAD

SEQ ID NO: 334050 - protein, 19 aa, Artificial Sequence
  Description of Artificial Sequence: Synthetic peptide
  Seed: PLTFALQLHDPSGYLAEAD (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEAD

SEQ ID NO: 334051 - protein, 19 aa, Artificial Sequence
  Description of Artificial Sequence: Synthetic peptide
  Seed: PLTFALQLHDPSGYLAEAD (PMEL_HUMAN)
  Core: LHDPSGYLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQXHDXSXYLXEAD

SEQ ID NO: 334052 - protein, 19 aa, Artificial Sequence
  Description of Artificial Sequence: Synthetic peptide
  Seed: PLTFALQLHDPSGYLAEAD (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAX

SEQ ID NO: 334053 - protein, 20 aa, Artificial Sequence
  Description of Artificial Sequence: Synthetic peptide
  Seed: PLTFALQLHDPSGYLAEADL (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYLAEADL

SEQ ID NO: 334054 - protein, 20 aa, Artificial Sequence
  Description of Artificial Sequence: Synthetic peptide
  Seed: PLTFALQLHDPSGYLAEADL (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEADL

SEQ ID NO: 334055 - protein, 20 aa, Artificial Sequence
  Description of Artificial Sequence: Synthetic peptide
  Seed: PLTFALQLHDPSGYLAEADL (PMEL_HUMAN)
  Core: LHDPSGYLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQXHDXSXYLXEADL

SEQ ID NO: 334056 - protein, 20 aa, Artificial Sequence
  Description of Artificial Sequence: Synthetic peptide
  Seed: PLTFALQLHDPSGYLAEADL (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAXL

SEQ ID NO: 334057 - protein, 21 aa, Artificial Sequence
  Description of Artificial Sequence: Synthetic peptide
  Seed: PLTFALQLHDPSGYLAEADLS (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYLAEADLS

SEQ ID NO: 334058 - protein, 21 aa, Artificial Sequence
  Description of Artificial Sequence: Synthetic peptide
  Seed: PLTFALQLHDPSGYLAEADLS (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEADLS

SEQ ID NO: 334059 - protein, 21 aa, Artificial Sequence
  Description of Artificial Sequence: Synthetic peptide
  Seed: PLTFALQLHDPSGYLAEADLS (PMEL_HUMAN)
  Core: LHDPSGYLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQXHDXSXYLXEADLS

SEQ ID NO: 334060 - protein, 21 aa, Artificial Sequence
  Description of Artificial Sequence: Synthetic peptide
  Seed: PLTFALQLHDPSGYLAEADLS (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAXLS

SEQ ID NO: 334061 - protein, 22 aa, Artificial Sequence
  Description of Artificial Sequence: Synthetic peptide
  Seed: PLTFALQLHDPSGYLAEADLSY (PMEL_HUMAN)
  Core: FALQLHDPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXALXLXDPXGYLAEADLSY

SEQ ID NO: 334062 - protein, 22 aa, Artificial Sequence
  Description of Artificial Sequence: Synthetic peptide
  Seed: PLTFALQLHDPSGYLAEADLSY (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEADLSY

SEQ ID NO: 334063 - protein, 22 aa, Artificial Sequence
  Description of Artificial Sequence: Synthetic peptide
  Seed: PLTFALQLHDPSGYLAEADLSY (PMEL_HUMAN)
  Core: LHDPSGYLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQXHDXSXYLXEADLSY

SEQ ID NO: 334064 - protein, 22 aa, Artificial Sequence
  Description of Artificial Sequence: Synthetic peptide
  Seed: PLTFALQLHDPSGYLAEADLSY (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAXLSY

SEQ ID NO: 334065 - protein, 22 aa, Artificial Sequence
  Description of Artificial Sequence: Synthetic peptide
  Seed: PLTFALQLHDPSGYLAEADLSY (PMEL_HUMAN)
  Core: YLAEADLSY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDPSGXLAXAXLSX

SEQ ID NO: 334066 - protein, 23 aa, Artificial Sequence
  Description of Artificial Sequence: Synthetic peptide
  Seed: PLTFALQLHDPSGYLAEADLSYT (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEADLSYT

SEQ ID NO: 334067 - protein, 23 aa, Artificial Sequence
  Description of Artificial Sequence: Synthetic peptide
  Seed: PLTFALQLHDPSGYLAEADLSYT (PMEL_HUMAN)
  Core: LHDPSGYLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQXHDXSXYLXEADLSYT

SEQ ID NO: 334068 - protein, 23 aa, Artificial Sequence
  Description of Artificial Sequence: Synthetic peptide
  Seed: PLTFALQLHDPSGYLAEADLSYT (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAXLSYT

SEQ ID NO: 334069 - protein, 23 aa, Artificial Sequence
  Description of Artificial Sequence: Synthetic peptide
  Seed: PLTFALQLHDPSGYLAEADLSYT (PMEL_HUMAN)
  Core: YLAEADLSY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDPSGXLAXAXLSXT

SEQ ID NO: 334070 - protein, 24 aa, Artificial Sequence
  Description of Artificial Sequence: Synthetic peptide
  Seed: PLTFALQLHDPSGYLAEADLSYTW (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEADLSYTW

SEQ ID NO: 334071 - protein, 24 aa, Artificial Sequence
  Description of Artificial Sequence: Synthetic peptide
  Seed: PLTFALQLHDPSGYLAEADLSYTW (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAXLSYTW

SEQ ID NO: 334072 - protein, 24 aa, Artificial Sequence
  Description of Artificial Sequence: Synthetic peptide
  Seed: PLTFALQLHDPSGYLAEADLSYTW (PMEL_HUMAN)
  Core: YLAEADLSY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDPSGXLAXAXLSXTW

SEQ ID NO: 334073 - protein, 25 aa, Artificial Sequence
  Description of Artificial Sequence: Synthetic peptide
  Seed: PLTFALQLHDPSGYLAEADLSYTWD (PMEL_HUMAN)
  Core: LQLHDPSGY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PLTFAXQLXDXSGXLAEADLSYTWD

SEQ ID NO: 334074 - protein, 25 aa, Artificial Sequence
  Description of Artificial Sequence: Synthetic peptide
  Seed: PLTFALQLHDPSGYLAEADLSYTWD (PMEL_HUMAN)
  Core: PSGYLAEAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDXSGXLXEAXLSYTWD

SEQ ID NO: 334075 - protein, 25 aa, Artificial Sequence
  Description of Artificial Sequence: Synthetic peptide
  Seed: PLTFALQLHDPSGYLAEADLSYTWD (PMEL_HUMAN)
  Core: YLAEADLSY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PLTFALQLHDPSGXLAXAXLSXTWD

SEQ ID NO: 334076 - protein, 14 aa, Artificial Sequence
  Description of Artificial Sequence: Synthetic peptide
  Seed: PLTSCGSSPVPGTT (PMEL_HUMAN)
  Core: SCGSSPVPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXCGXSXVPXTT

SEQ ID NO: 334077 - protein, 15 aa, Artificial Sequence
  Description of Artificial Sequence: Synthetic peptide
  Seed: PLTSCGSSPVPGTTD (PMEL_HUMAN)
  Core: SCGSSPVPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PLTXCGXSXVPXTTD

SEQ ID NO: 334078 - protein, 16 aa, Artificial Sequence
  Description of Artificial Sequence: Synthetic peptide
  Seed: PLTSCGSSPVPGTTDG (PMEL_HUMAN)
  Core: CGSSPVPGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLTSXGSXPXPGXTDG

SEQ ID NO: 334079 - protein, 17 aa, Artificial Sequence
  Description of Artificial Sequence: Synthetic peptide
  Seed: PLTSCGSSPVPGTTDGH (PMEL_HUMAN)
  Core: CGSSPVPGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLTSXGSXPXPGXTDGH

SEQ ID NO: 334080 - protein, 20 aa, Artificial Sequence
  Description of Artificial Sequence: Synthetic peptide
  Seed: PLTSCGSSPVPGTTDGHRPT (PMEL_HUMAN)
  Core: PVPGTTDGH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PLTSCGSSXVPXTXDGXRPT

SEQ ID NO: 334081 - protein, 13 aa, Artificial Sequence
  Description of Artificial Sequence: Synthetic peptide
  Seed: PNTTAGQVPTTEV (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEV

SEQ ID NO: 334082 - protein, 14 aa, Artificial Sequence
  Description of Artificial Sequence: Synthetic peptide
  Seed: PNTTAGQVPTTEVV (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEVV

SEQ ID NO: 334083 - protein, 15 aa, Artificial Sequence
  Description of Artificial Sequence: Synthetic peptide
  Seed: PNTTAGQVPTTEVVG (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEVVG

SEQ ID NO: 334084 - protein, 16 aa, Artificial Sequence
  Description of Artificial Sequence: Synthetic peptide
  Seed: PNTTAGQVPTTEVVGT (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEVVGT

SEQ ID NO: 334085 - protein, 17 aa, Artificial Sequence
  Description of Artificial Sequence: Synthetic peptide
  Seed: PNTTAGQVPTTEVVGTT (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEVVGTT

SEQ ID NO: 334086 - protein, 18 aa, Artificial Sequence
  Description of Artificial Sequence: Synthetic peptide
  Seed: PNTTAGQVPTTEVVGTTP (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEVVGTTP

SEQ ID NO: 334087 - protein, 19 aa, Artificial Sequence
  Description of Artificial Sequence: Synthetic peptide
  Seed: PNTTAGQVPTTEVVGTTPG (PMEL_HUMAN)
  Core: TTAGQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PNXTAXQXPTXEVVGTTPG

SEQ ID NO: 334088 - protein, 20 aa, Artificial Sequence
  Description of Artificial Sequence: Synthetic peptide
  Seed: PNTTAGQVPTTEVVGTTPGQ (PMEL_HUMAN)
  Core: PTTEVVGTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVXTTXVXGTXPGQ

SEQ ID NO: 334089 - protein, 21 aa, Artificial Sequence
  Description of Artificial Sequence: Synthetic peptide
  Seed: PNTTAGQVPTTEVVGTTPGQA (PMEL_HUMAN)
  Core: PTTEVVGTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVXTTXVXGTXPGQA

SEQ ID NO: 334090 - protein, 22 aa, Artificial Sequence
  Description of Artificial Sequence: Synthetic peptide
  Seed: PNTTAGQVPTTEVVGTTPGQAP (PMEL_HUMAN)
  Core: PTTEVVGTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVXTTXVXGTXPGQAP

SEQ ID NO: 334091 - protein, 22 aa, Artificial Sequence
  Description of Artificial Sequence: Synthetic peptide
  Seed: PNTTAGQVPTTEVVGTTPGQAP (PMEL_HUMAN)
  Core: VVGTTPGQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVPTTEXVGXTXGQXP

SEQ ID NO: 334092 - protein, 23 aa, Artificial Sequence
  Description of Artificial Sequence: Synthetic peptide
  Seed: PNTTAGQVPTTEVVGTTPGQAPT (PMEL_HUMAN)
  Core: PTTEVVGTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVXTTXVXGTXPGQAPT

SEQ ID NO: 334093 - protein, 23 aa, Artificial Sequence
  Description of Artificial Sequence: Synthetic peptide
  Seed: PNTTAGQVPTTEVVGTTPGQAPT (PMEL_HUMAN)
  Core: VVGTTPGQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVPTTEXVGXTXGQXPT

SEQ ID NO: 334094 - protein, 24 aa, Artificial Sequence
  Description of Artificial Sequence: Synthetic peptide
  Seed: PNTTAGQVPTTEVVGTTPGQAPTA (PMEL_HUMAN)
  Core: VVGTTPGQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVPTTEXVGXTXGQXPTA

SEQ ID NO: 334095 - protein, 25 aa, Artificial Sequence
  Description of Artificial Sequence: Synthetic peptide
  Seed: PNTTAGQVPTTEVVGTTPGQAPTAE (PMEL_HUMAN)
  Core: VVGTTPGQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PNTTAGQVPTTEXVGXTXGQXPTAE

SEQ ID NO: 334096 - protein, 15 aa, Artificial Sequence
  Description of Artificial Sequence: Synthetic peptide
  Seed: PPAQRLCQPVLPSPA (PMEL_HUMAN)
  Core: QRLCQPVLP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PPAXRLXQXVLXSPA

SEQ ID NO: 334097 - protein, 15 aa, Artificial Sequence
  Description of Artificial Sequence: Synthetic peptide
  Seed: PPAQRLCQPVLPSPA (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPA

SEQ ID NO: 334098 - protein, 17 aa, Artificial Sequence
  Description of Artificial Sequence: Synthetic peptide
  Seed: PPAQRLCQPVLPSPACQ (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPACQ

SEQ ID NO: 334099 - protein, 19 aa, Artificial Sequence
  Description of Artificial Sequence: Synthetic peptide
  Seed: PPAQRLCQPVLPSPACQLV (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPACQLV

SEQ ID NO: 334100 - protein, 19 aa, Artificial Sequence
  Description of Artificial Sequence: Synthetic peptide
  Seed: PPAQRLCQPVLPSPACQLV (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXV

SEQ ID NO: 334101 - protein, 20 aa, Artificial Sequence
  Description of Artificial Sequence: Synthetic peptide
  Seed: PPAQRLCQPVLPSPACQLVL (PMEL_HUMAN)
  Core: QRLCQPVLP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PPAXRLXQXVLXSPACQLVL

SEQ ID NO: 334102 - protein, 20 aa, Artificial Sequence
  Description of Artificial Sequence: Synthetic peptide
  Seed: PPAQRLCQPVLPSPACQLVL (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPACQLVL

SEQ ID NO: 334103 - protein, 20 aa, Artificial Sequence
  Description of Artificial Sequence: Synthetic peptide
  Seed: PPAQRLCQPVLPSPACQLVL (PMEL_HUMAN)
  Core: CQPVLPSPA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLXQPXLXSPXCQLVL

SEQ ID NO: 334104 - protein, 20 aa, Artificial Sequence
  Description of Artificial Sequence: Synthetic peptide
  Seed: PPAQRLCQPVLPSPACQLVL (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXVL

SEQ ID NO: 334105 - protein, 21 aa, Artificial Sequence
  Description of Artificial Sequence: Synthetic peptide
  Seed: PPAQRLCQPVLPSPACQLVLH (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXVLH

SEQ ID NO: 334106 - protein, 22 aa, Artificial Sequence
  Description of Artificial Sequence: Synthetic peptide
  Seed: PPAQRLCQPVLPSPACQLVLHQ (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXVLHQ

SEQ ID NO: 334107 - protein, 23 aa, Artificial Sequence
  Description of Artificial Sequence: Synthetic peptide
  Seed: PPAQRLCQPVLPSPACQLVLHQI (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPACQLVLHQI

SEQ ID NO: 334108 - protein, 23 aa, Artificial Sequence
  Description of Artificial Sequence: Synthetic peptide
  Seed: PPAQRLCQPVLPSPACQLVLHQI (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXVLHQI

SEQ ID NO: 334109 - protein, 24 aa, Artificial Sequence
  Description of Artificial Sequence: Synthetic peptide
  Seed: PPAQRLCQPVLPSPACQLVLHQIL (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPACQLVLHQIL

SEQ ID NO: 334110 - protein, 24 aa, Artificial Sequence
  Description of Artificial Sequence: Synthetic peptide
  Seed: PPAQRLCQPVLPSPACQLVLHQIL (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXVLHQIL

SEQ ID NO: 334111 - protein, 25 aa, Artificial Sequence
  Description of Artificial Sequence: Synthetic peptide
  Seed: PPAQRLCQPVLPSPACQLVLHQILK (PMEL_HUMAN)
  Core: RLCQPVLPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPAQXLCXPXLPXPACQLVLHQILK

SEQ ID NO: 334112 - protein, 25 aa, Artificial Sequence
  Description of Artificial Sequence: Synthetic peptide
  Seed: PPAQRLCQPVLPSPACQLVLHQILK (PMEL_HUMAN)
  Core: CQPVLPSPA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLXQPXLXSPXCQLVLHQILK

SEQ ID NO: 334113 - protein, 25 aa, Artificial Sequence
  Description of Artificial Sequence: Synthetic peptide
  Seed: PPAQRLCQPVLPSPACQLVLHQILK (PMEL_HUMAN)
  Core: VLPSPACQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPXLPXPXCQXVLHQILK

SEQ ID NO: 334114 - protein, 25 aa, Artificial Sequence
  Description of Artificial Sequence: Synthetic peptide
  Seed: PPAQRLCQPVLPSPACQLVLHQILK (PMEL_HUMAN)
  Core: CQLVLHQIL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PPAQRLCQPVLPSPAXQLXLXQIXK

SEQ ID NO: 334115 - protein, 14 aa, Artificial Sequence
  Description of Artificial Sequence: Synthetic peptide
  Seed: PQLPHSSSHWLRLP (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXP

SEQ ID NO: 334116 - protein, 15 aa, Artificial Sequence
  Description of Artificial Sequence: Synthetic peptide
  Seed: PQLPHSSSHWLRLPR (PMEL_HUMAN)
  Core: LPHSSSHWL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PQXPHXSXHWXRLPR

SEQ ID NO: 334117 - protein, 15 aa, Artificial Sequence
  Description of Artificial Sequence: Synthetic peptide
  Seed: PQLPHSSSHWLRLPR (PMEL_HUMAN)
  Core: PHSSSHWLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQLXHSXSXWLXLPR

SEQ ID NO: 334118 - protein, 15 aa, Artificial Sequence
  Description of Artificial Sequence: Synthetic peptide
  Seed: PQLPHSSSHWLRLPR (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPR

SEQ ID NO: 334119 - protein, 16 aa, Artificial Sequence
  Description of Artificial Sequence: Synthetic peptide
  Seed: PQLPHSSSHWLRLPRI (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRI

SEQ ID NO: 334120 - protein, 16 aa, Artificial Sequence
  Description of Artificial Sequence: Synthetic peptide
  Seed: PQLPHSSSHWLRLPRI (PMEL_HUMAN)
  Core: SSHWLRLPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSXSHXLXLPXI

SEQ ID NO: 334121 - protein, 17 aa, Artificial Sequence
  Description of Artificial Sequence: Synthetic peptide
  Seed: PQLPHSSSHWLRLPRIF (PMEL_HUMAN)
  Core: PHSSSHWLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PQLXHSXSXWLXLPRIF

SEQ ID NO: 334122 - protein, 17 aa, Artificial Sequence
  Description of Artificial Sequence: Synthetic peptide
  Seed: PQLPHSSSHWLRLPRIF (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIF

SEQ ID NO: 334123 - protein, 17 aa, Artificial Sequence
  Description of Artificial Sequence: Synthetic peptide
  Seed: PQLPHSSSHWLRLPRIF (PMEL_HUMAN)
  Core: SSHWLRLPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSXSHXLXLPXIF

SEQ ID NO: 334124 - protein, 18 aa, Artificial Sequence
  Description of Artificial Sequence: Synthetic peptide
  Seed: PQLPHSSSHWLRLPRIFC (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFC

SEQ ID NO: 334125 - protein, 19 aa, Artificial Sequence
  Description of Artificial Sequence: Synthetic peptide
  Seed: PQLPHSSSHWLRLPRIFCS (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCS

SEQ ID NO: 334126 - protein, 19 aa, Artificial Sequence
  Description of Artificial Sequence: Synthetic peptide
  Seed: PQLPHSSSHWLRLPRIFCS (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCS

SEQ ID NO: 334127 - protein, 19 aa, Artificial Sequence
  Description of Artificial Sequence: Synthetic peptide
  Seed: PQLPHSSSHWLRLPRIFCS (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXS

SEQ ID NO: 334128 - protein, 20 aa, Artificial Sequence
  Description of Artificial Sequence: Synthetic peptide
  Seed: PQLPHSSSHWLRLPRIFCSC (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCSC

SEQ ID NO: 334129 - protein, 20 aa, Artificial Sequence
  Description of Artificial Sequence: Synthetic peptide
  Seed: PQLPHSSSHWLRLPRIFCSC (PMEL_HUMAN)
  Core: SSHWLRLPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSXSHXLXLPXIFCSC

SEQ ID NO: 334130 - protein, 20 aa, Artificial Sequence
  Description of Artificial Sequence: Synthetic peptide
  Seed: PQLPHSSSHWLRLPRIFCSC (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCSC

SEQ ID NO: 334131 - protein, 20 aa, Artificial Sequence
  Description of Artificial Sequence: Synthetic peptide
  Seed: PQLPHSSSHWLRLPRIFCSC (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXSC

SEQ ID NO: 334132 - protein, 21 aa, Artificial Sequence
  Description of Artificial Sequence: Synthetic peptide
  Seed: PQLPHSSSHWLRLPRIFCSCP (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCSCP

SEQ ID NO: 334133 - protein, 21 aa, Artificial Sequence
  Description of Artificial Sequence: Synthetic peptide
  Seed: PQLPHSSSHWLRLPRIFCSCP (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCSCP

SEQ ID NO: 334134 - protein, 21 aa, Artificial Sequence
  Description of Artificial Sequence: Synthetic peptide
  Seed: PQLPHSSSHWLRLPRIFCSCP (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXSCP

SEQ ID NO: 334135 - protein, 22 aa, Artificial Sequence
  Description of Artificial Sequence: Synthetic peptide
  Seed: PQLPHSSSHWLRLPRIFCSCPI (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCSCPI

SEQ ID NO: 334136 - protein, 22 aa, Artificial Sequence
  Description of Artificial Sequence: Synthetic peptide
  Seed: PQLPHSSSHWLRLPRIFCSCPI (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCSCPI

SEQ ID NO: 334137 - protein, 22 aa, Artificial Sequence
  Description of Artificial Sequence: Synthetic peptide
  Seed: PQLPHSSSHWLRLPRIFCSCPI (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXSCPI

SEQ ID NO: 334138 - protein, 23 aa, Artificial Sequence
  Description of Artificial Sequence: Synthetic peptide
  Seed: PQLPHSSSHWLRLPRIFCSCPIG (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCSCPIG

SEQ ID NO: 334139 - protein, 23 aa, Artificial Sequence
  Description of Artificial Sequence: Synthetic peptide
  Seed: PQLPHSSSHWLRLPRIFCSCPIG (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCSCPIG

SEQ ID NO: 334140 - protein, 23 aa, Artificial Sequence
  Description of Artificial Sequence: Synthetic peptide
  Seed: PQLPHSSSHWLRLPRIFCSCPIG (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXSCPIG

SEQ ID NO: 334141 - protein, 23 aa, Artificial Sequence
  Description of Artificial Sequence: Synthetic peptide
  Seed: PQLPHSSSHWLRLPRIFCSCPIG (PMEL_HUMAN)
  Core: PRIFCSCPI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHWLRLXRIXCXCPXG

SEQ ID NO: 334142 - protein, 24 aa, Artificial Sequence
  Description of Artificial Sequence: Synthetic peptide
  Seed: PQLPHSSSHWLRLPRIFCSCPIGE (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCSCPIGE

SEQ ID NO: 334143 - protein, 24 aa, Artificial Sequence
  Description of Artificial Sequence: Synthetic peptide
  Seed: PQLPHSSSHWLRLPRIFCSCPIGE (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCSCPIGE

SEQ ID NO: 334144 - protein, 24 aa, Artificial Sequence
  Description of Artificial Sequence: Synthetic peptide
  Seed: PQLPHSSSHWLRLPRIFCSCPIGE (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXSCPIGE

SEQ ID NO: 334145 - protein, 24 aa, Artificial Sequence
  Description of Artificial Sequence: Synthetic peptide
  Seed: PQLPHSSSHWLRLPRIFCSCPIGE (PMEL_HUMAN)
  Core: PRIFCSCPI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHWLRLXRIXCXCPXGE

SEQ ID NO: 334146 - protein, 25 aa, Artificial Sequence
  Description of Artificial Sequence: Synthetic peptide
  Seed: PQLPHSSSHWLRLPRIFCSCPIGEN (PMEL_HUMAN)
  Core: HSSSHWLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PQLPXSSXHXLRXPRIFCSCPIGEN

SEQ ID NO: 334147 - protein, 25 aa, Artificial Sequence
  Description of Artificial Sequence: Synthetic peptide
  Seed: PQLPHSSSHWLRLPRIFCSCPIGEN (PMEL_HUMAN)
  Core: SHWLRLPRI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSXHWXRXPRXFCSCPIGEN

SEQ ID NO: 334148 - protein, 25 aa, Artificial Sequence
  Description of Artificial Sequence: Synthetic peptide
  Seed: PQLPHSSSHWLRLPRIFCSCPIGEN (PMEL_HUMAN)
  Core: WLRLPRIFC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHXLRXPXIFXSCPIGEN

SEQ ID NO: 334149 - protein, 25 aa, Artificial Sequence
  Description of Artificial Sequence: Synthetic peptide
  Seed: PQLPHSSSHWLRLPRIFCSCPIGEN (PMEL_HUMAN)
  Core: PRIFCSCPI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHWLRLXRIXCXCPXGEN

SEQ ID NO: 334150 - protein, 25 aa, Artificial Sequence
  Description of Artificial Sequence: Synthetic peptide
  Seed: PQLPHSSSHWLRLPRIFCSCPIGEN (PMEL_HUMAN)
  Core: RIFCSCPIG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PQLPHSSSHWLRLPXIFXSXPIXEN

SEQ ID NO: 334151 - protein, 15 aa, Artificial Sequence
  Description of Artificial Sequence: Synthetic peptide
  Seed: PRIFCSCPIGENSPL (PMEL_HUMAN)
  Core: FCSCPIGEN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PRIXCSXPXGEXSPL

SEQ ID NO: 334152 - protein, 15 aa, Artificial Sequence
  Description of Artificial Sequence: Synthetic peptide
  Seed: PRNQDWLGVSRQLRT (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXT

SEQ ID NO: 334153 - protein, 16 aa, Artificial Sequence
  Description of Artificial Sequence: Synthetic peptide
  Seed: PRNQDWLGVSRQLRTK (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTK

SEQ ID NO: 334154 - protein, 17 aa, Artificial Sequence
  Description of Artificial Sequence: Synthetic peptide
  Seed: PRNQDWLGVSRQLRTKA (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKA

SEQ ID NO: 334155 - protein, 18 aa, Artificial Sequence
  Description of Artificial Sequence: Synthetic peptide
  Seed: PRNQDWLGVSRQLRTKAW (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAW

SEQ ID NO: 334156 - protein, 19 aa, Artificial Sequence
  Description of Artificial Sequence: Synthetic peptide
  Seed: PRNQDWLGVSRQLRTKAWN (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWN

SEQ ID NO: 334157 - protein, 19 aa, Artificial Sequence
  Description of Artificial Sequence: Synthetic peptide
  Seed: PRNQDWLGVSRQLRTKAWN (PMEL_HUMAN)
  Core: LGVSRQLRT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWXGVXRXLRXKAWN

SEQ ID NO: 334158 - protein, 20 aa, Artificial Sequence
  Description of Artificial Sequence: Synthetic peptide
  Seed: PRNQDWLGVSRQLRTKAWNR (PMEL_HUMAN)
  Core: DWLGVSRQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PRNQXWLXVXRQXRTKAWNR

SEQ ID NO: 334159 - protein, 20 aa, Artificial Sequence
  Description of Artificial Sequence: Synthetic peptide
  Seed: PRNQDWLGVSRQLRTKAWNR (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWNR

SEQ ID NO: 334160 - protein, 20 aa, Artificial Sequence
  Description of Artificial Sequence: Synthetic peptide
  Seed: PRNQDWLGVSRQLRTKAWNR (PMEL_HUMAN)
  Core: LGVSRQLRT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWXGVXRXLRXKAWNR

SEQ ID NO: 334161 - protein, 21 aa, Artificial Sequence
  Description of Artificial Sequence: Synthetic peptide
  Seed: PRNQDWLGVSRQLRTKAWNRQ (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWNRQ

SEQ ID NO: 334162 - protein, 22 aa, Artificial Sequence
  Description of Artificial Sequence: Synthetic peptide
  Seed: PRNQDWLGVSRQLRTKAWNRQL (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWNRQL

SEQ ID NO: 334163 - protein, 22 aa, Artificial Sequence
  Description of Artificial Sequence: Synthetic peptide
  Seed: PRNQDWLGVSRQLRTKAWNRQL (PMEL_HUMAN)
  Core: LRTKAWNRQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWLGVSRQXRTXAXNRXL

SEQ ID NO: 334164 - protein, 23 aa, Artificial Sequence
  Description of Artificial Sequence: Synthetic peptide
  Seed: PRNQDWLGVSRQLRTKAWNRQLY (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWNRQLY

SEQ ID NO: 334165 - protein, 23 aa, Artificial Sequence
  Description of Artificial Sequence: Synthetic peptide
  Seed: PRNQDWLGVSRQLRTKAWNRQLY (PMEL_HUMAN)
  Core: LRTKAWNRQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWLGVSRQXRTXAXNRXLY

SEQ ID NO: 334166 - protein, 24 aa, Artificial Sequence
  Description of Artificial Sequence: Synthetic peptide
  Seed: PRNQDWLGVSRQLRTKAWNRQLYP (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWNRQLYP

SEQ ID NO: 334167 - protein, 24 aa, Artificial Sequence
  Description of Artificial Sequence: Synthetic peptide
  Seed: PRNQDWLGVSRQLRTKAWNRQLYP (PMEL_HUMAN)
  Core: LRTKAWNRQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWLGVSRQXRTXAXNRXLYP

SEQ ID NO: 334168 - protein, 25 aa, Artificial Sequence
  Description of Artificial Sequence: Synthetic peptide
  Seed: PRNQDWLGVSRQLRTKAWNRQLYPE (PMEL_HUMAN)
  Core: WLGVSRQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDXLGXSXQLXTKAWNRQLYPE

SEQ ID NO: 334169 - protein, 25 aa, Artificial Sequence
  Description of Artificial Sequence: Synthetic peptide
  Seed: PRNQDWLGVSRQLRTKAWNRQLYPE (PMEL_HUMAN)
  Core: LRTKAWNRQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWLGVSRQXRTXAXNRXLYPE

SEQ ID NO: 334170 - protein, 25 aa, Artificial Sequence
  Description of Artificial Sequence: Synthetic peptide
  Seed: PRNQDWLGVSRQLRTKAWNRQLYPE (PMEL_HUMAN)
  Core: TKAWNRQLY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PRNQDWLGVSRQLRXKAXNXQLXPE

SEQ ID NO: 334171 - protein, 20 aa, Artificial Sequence
  Description of Artificial Sequence: Synthetic peptide
  Seed: PSGEGDAFELTVSCQGGLPK (PMEL_HUMAN)
  Core: FELTVSCQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PSGEGDAXELXVXCQXGLPK

SEQ ID NO: 334172 - protein, 24 aa, Artificial Sequence
  Description of Artificial Sequence: Synthetic peptide
  Seed: PSGEGDAFELTVSCQGGLPKEACM (PMEL_HUMAN)
  Core: CQGGLPKEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PSGEGDAFELTVSXQGXLXKEXCM

SEQ ID NO: 334173 - protein, 25 aa, Artificial Sequence
  Description of Artificial Sequence: Synthetic peptide
  Seed: PSGEGDAFELTVSCQGGLPKEACME (PMEL_HUMAN)
  Core: CQGGLPKEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PSGEGDAFELTVSXQGXLXKEXCME

SEQ ID NO: 334174 - protein, 15 aa, Artificial Sequence
  Description of Artificial Sequence: Synthetic peptide
  Seed: PSGSWSQKRSFVYVW (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVW

SEQ ID NO: 334175 - protein, 16 aa, Artificial Sequence
  Description of Artificial Sequence: Synthetic peptide
  Seed: PSGSWSQKRSFVYVWK (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWK

SEQ ID NO: 334176 - protein, 17 aa, Artificial Sequence
  Description of Artificial Sequence: Synthetic peptide
  Seed: PSGSWSQKRSFVYVWKT (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWKT

SEQ ID NO: 334177 - protein, 17 aa, Artificial Sequence
  Description of Artificial Sequence: Synthetic peptide
  Seed: PSGSWSQKRSFVYVWKT (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKX

SEQ ID NO: 334178 - protein, 19 aa, Artificial Sequence
  Description of Artificial Sequence: Synthetic peptide
  Seed: PSGSWSQKRSFVYVWKTWG (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWKTWG

SEQ ID NO: 334179 - protein, 19 aa, Artificial Sequence
  Description of Artificial Sequence: Synthetic peptide
  Seed: PSGSWSQKRSFVYVWKTWG (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWG

SEQ ID NO: 334180 - protein, 19 aa, Artificial Sequence
  Description of Artificial Sequence: Synthetic peptide
  Seed: PSGSWSQKRSFVYVWKTWG (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWX

SEQ ID NO: 334181 - protein, 20 aa, Artificial Sequence
  Description of Artificial Sequence: Synthetic peptide
  Seed: PSGSWSQKRSFVYVWKTWGQ (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWKTWGQ

SEQ ID NO: 334182 - protein, 20 aa, Artificial Sequence
  Description of Artificial Sequence: Synthetic peptide
  Seed: PSGSWSQKRSFVYVWKTWGQ (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWGQ

SEQ ID NO: 334183 - protein, 20 aa, Artificial Sequence
  Description of Artificial Sequence: Synthetic peptide
  Seed: PSGSWSQKRSFVYVWKTWGQ (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWXQ

SEQ ID NO: 334184 - protein, 20 aa, Artificial Sequence
  Description of Artificial Sequence: Synthetic peptide
  Seed: PSGSWSQKRSFVYVWKTWGQ (PMEL_HUMAN)
  Core: VYVWKTWGQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFXYVXKXWGX

SEQ ID NO: 334185 - protein, 21 aa, Artificial Sequence
  Description of Artificial Sequence: Synthetic peptide
  Seed: PSGSWSQKRSFVYVWKTWGQY (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWKTWGQY

SEQ ID NO: 334186 - protein, 21 aa, Artificial Sequence
  Description of Artificial Sequence: Synthetic peptide
  Seed: PSGSWSQKRSFVYVWKTWGQY (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWGQY

SEQ ID NO: 334187 - protein, 21 aa, Artificial Sequence
  Description of Artificial Sequence: Synthetic peptide
  Seed: PSGSWSQKRSFVYVWKTWGQY (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWXQY

SEQ ID NO: 334188 - protein, 21 aa, Artificial Sequence
  Description of Artificial Sequence: Synthetic peptide
  Seed: PSGSWSQKRSFVYVWKTWGQY (PMEL_HUMAN)
  Core: VYVWKTWGQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFXYVXKXWGXY

SEQ ID NO: 334189 - protein, 21 aa, Artificial Sequence
  Description of Artificial Sequence: Synthetic peptide
  Seed: PSGSWSQKRSFVYVWKTWGQY (PMEL_HUMAN)
  Core: YVWKTWGQY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFVXVWXTXGQX

SEQ ID NO: 334190 - protein, 22 aa, Artificial Sequence
  Description of Artificial Sequence: Synthetic peptide
  Seed: PSGSWSQKRSFVYVWKTWGQYW (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWGQYW

SEQ ID NO: 334191 - protein, 22 aa, Artificial Sequence
  Description of Artificial Sequence: Synthetic peptide
  Seed: PSGSWSQKRSFVYVWKTWGQYW (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWXQYW

SEQ ID NO: 334192 - protein, 22 aa, Artificial Sequence
  Description of Artificial Sequence: Synthetic peptide
  Seed: PSGSWSQKRSFVYVWKTWGQYW (PMEL_HUMAN)
  Core: VYVWKTWGQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFXYVXKXWGXYW

SEQ ID NO: 334193 - protein, 22 aa, Artificial Sequence
  Description of Artificial Sequence: Synthetic peptide
  Seed: PSGSWSQKRSFVYVWKTWGQYW (PMEL_HUMAN)
  Core: YVWKTWGQY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFVXVWXTXGQXW

SEQ ID NO: 334194 - protein, 23 aa, Artificial Sequence
  Description of Artificial Sequence: Synthetic peptide
  Seed: PSGSWSQKRSFVYVWKTWGQYWQ (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWGQYWQ

SEQ ID NO: 334195 - protein, 23 aa, Artificial Sequence
  Description of Artificial Sequence: Synthetic peptide
  Seed: PSGSWSQKRSFVYVWKTWGQYWQ (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWXQYWQ

SEQ ID NO: 334196 - protein, 23 aa, Artificial Sequence
  Description of Artificial Sequence: Synthetic peptide
  Seed: PSGSWSQKRSFVYVWKTWGQYWQ (PMEL_HUMAN)
  Core: VYVWKTWGQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFXYVXKXWGXYWQ

SEQ ID NO: 334197 - protein, 23 aa, Artificial Sequence
  Description of Artificial Sequence: Synthetic peptide
  Seed: PSGSWSQKRSFVYVWKTWGQYWQ (PMEL_HUMAN)
  Core: YVWKTWGQY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFVXVWXTXGQXWQ

SEQ ID NO: 334198 - protein, 24 aa, Artificial Sequence
  Description of Artificial Sequence: Synthetic peptide
  Seed: PSGSWSQKRSFVYVWKTWGQYWQV (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWKTWGQYWQV

SEQ ID NO: 334199 - protein, 24 aa, Artificial Sequence
  Description of Artificial Sequence: Synthetic peptide
  Seed: PSGSWSQKRSFVYVWKTWGQYWQV (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWGQYWQV

SEQ ID NO: 334200 - protein, 24 aa, Artificial Sequence
  Description of Artificial Sequence: Synthetic peptide
  Seed: PSGSWSQKRSFVYVWKTWGQYWQV (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWXQYWQV

SEQ ID NO: 334201 - protein, 24 aa, Artificial Sequence
  Description of Artificial Sequence: Synthetic peptide
  Seed: PSGSWSQKRSFVYVWKTWGQYWQV (PMEL_HUMAN)
  Core: VYVWKTWGQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFXYVXKXWGXYWQV

SEQ ID NO: 334202 - protein, 24 aa, Artificial Sequence
  Description of Artificial Sequence: Synthetic peptide
  Seed: PSGSWSQKRSFVYVWKTWGQYWQV (PMEL_HUMAN)
  Core: YVWKTWGQY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFVXVWXTXGQXWQV

SEQ ID NO: 334203 - protein, 25 aa, Artificial Sequence
  Description of Artificial Sequence: Synthetic peptide
  Seed: PSGSWSQKRSFVYVWKTWGQYWQVL (PMEL_HUMAN)
  Core: WSQKRSFVY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGSXSQXRXFVXVWKTWGQYWQVL

SEQ ID NO: 334204 - protein, 25 aa, Artificial Sequence
  Description of Artificial Sequence: Synthetic peptide
  Seed: PSGSWSQKRSFVYVWKTWGQYWQVL (PMEL_HUMAN)
  Core: RSFVYVWKT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKXSFXYXWKXWGQYWQVL

SEQ ID NO: 334205 - protein, 25 aa, Artificial Sequence
  Description of Artificial Sequence: Synthetic peptide
  Seed: PSGSWSQKRSFVYVWKTWGQYWQVL (PMEL_HUMAN)
  Core: FVYVWKTWG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSXVYXWXTWXQYWQVL

SEQ ID NO: 334206 - protein, 25 aa, Artificial Sequence
  Description of Artificial Sequence: Synthetic peptide
  Seed: PSGSWSQKRSFVYVWKTWGQYWQVL (PMEL_HUMAN)
  Core: VYVWKTWGQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFXYVXKXWGXYWQVL

SEQ ID NO: 334207 - protein, 25 aa, Artificial Sequence
  Description of Artificial Sequence: Synthetic peptide
  Seed: PSGSWSQKRSFVYVWKTWGQYWQVL (PMEL_HUMAN)
  Core: YVWKTWGQY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PSGSWSQKRSFVXVWXTXGQXWQVL

SEQ ID NO: 334208 - protein, 14 aa, Artificial Sequence
  Description of Artificial Sequence: Synthetic peptide
  Seed: PSGTTSVQVPTTEV (PMEL_HUMAN)
  Core: TTSVQVPTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXTSXQXPTXEV

SEQ ID NO: 334209 - protein, 15 aa, Artificial Sequence
  Description of Artificial Sequence: Synthetic peptide
  Seed: PSGTTSVQVPTTEVI (PMEL_HUMAN)
  Core: TTSVQVPTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXTSXQXPTXEVI

SEQ ID NO: 334210 - protein, 16 aa, Artificial Sequence
  Description of Artificial Sequence: Synthetic peptide
  Seed: PSGTTSVQVPTTEVIS (PMEL_HUMAN)
  Core: TTSVQVPTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXTSXQXPTXEVIS

SEQ ID NO: 334211 - protein, 17 aa, Artificial Sequence
  Description of Artificial Sequence: Synthetic peptide
  Seed: PSGTTSVQVPTTEVIST (PMEL_HUMAN)
  Core: TTSVQVPTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXTSXQXPTXEVIST

SEQ ID NO: 334212 - protein, 19 aa, Artificial Sequence
  Description of Artificial Sequence: Synthetic peptide
  Seed: PSGTTSVQVPTTEVISTAP (PMEL_HUMAN)
  Core: TTSVQVPTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXTSXQXPTXEVISTAP

SEQ ID NO: 334213 - protein, 20 aa, Artificial Sequence
  Description of Artificial Sequence: Synthetic peptide
  Seed: PSGTTSVQVPTTEVISTAPV (PMEL_HUMAN)
  Core: TTSVQVPTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXTSXQXPTXEVISTAPV

SEQ ID NO: 334214 - protein, 20 aa, Artificial Sequence
  Description of Artificial Sequence: Synthetic peptide
  Seed: PSGTTSVQVPTTEVISTAPV (PMEL_HUMAN)
  Core: PTTEVISTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVXTTXVXSTXPV

SEQ ID NO: 334215 - protein, 21 aa, Artificial Sequence
  Description of Artificial Sequence: Synthetic peptide
  Seed: PSGTTSVQVPTTEVISTAPVQ (PMEL_HUMAN)
  Core: PTTEVISTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVXTTXVXSTXPVQ

SEQ ID NO: 334216 - protein, 22 aa, Artificial Sequence
  Description of Artificial Sequence: Synthetic peptide
  Seed: PSGTTSVQVPTTEVISTAPVQM (PMEL_HUMAN)
  Core: PTTEVISTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVXTTXVXSTXPVQM

SEQ ID NO: 334217 - protein, 22 aa, Artificial Sequence
  Description of Artificial Sequence: Synthetic peptide
  Seed: PSGTTSVQVPTTEVISTAPVQM (PMEL_HUMAN)
  Core: VISTAPVQM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTTEXISXAXVQX

SEQ ID NO: 334218 - protein, 23 aa, Artificial Sequence
  Description of Artificial Sequence: Synthetic peptide
  Seed: PSGTTSVQVPTTEVISTAPVQMP (PMEL_HUMAN)
  Core: QVPTTEVIS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVXVPXTXVIXTAPVQMP

SEQ ID NO: 334219 - protein, 23 aa, Artificial Sequence
  Description of Artificial Sequence: Synthetic peptide
  Seed: PSGTTSVQVPTTEVISTAPVQMP (PMEL_HUMAN)
  Core: PTTEVISTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVXTTXVXSTXPVQMP

SEQ ID NO: 334220 - protein, 23 aa, Artificial Sequence
  Description of Artificial Sequence: Synthetic peptide
  Seed: PSGTTSVQVPTTEVISTAPVQMP (PMEL_HUMAN)
  Core: TEVISTAPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTXEVXSXAPXQMP

SEQ ID NO: 334221 - protein, 23 aa, Artificial Sequence
  Description of Artificial Sequence: Synthetic peptide
  Seed: PSGTTSVQVPTTEVISTAPVQMP (PMEL_HUMAN)
  Core: VISTAPVQM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTTEXISXAXVQXP

SEQ ID NO: 334222 - protein, 24 aa, Artificial Sequence
  Description of Artificial Sequence: Synthetic peptide
  Seed: PSGTTSVQVPTTEVISTAPVQMPT (PMEL_HUMAN)
  Core: PTTEVISTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVXTTXVXSTXPVQMPT

SEQ ID NO: 334223 - protein, 24 aa, Artificial Sequence
  Description of Artificial Sequence: Synthetic peptide
  Seed: PSGTTSVQVPTTEVISTAPVQMPT (PMEL_HUMAN)
  Core: TEVISTAPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTXEVXSXAPXQMPT

SEQ ID NO: 334224 - protein, 24 aa, Artificial Sequence
  Description of Artificial Sequence: Synthetic peptide
  Seed: PSGTTSVQVPTTEVISTAPVQMPT (PMEL_HUMAN)
  Core: VISTAPVQM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTTEXISXAXVQXPT

SEQ ID NO: 334225 - protein, 25 aa, Artificial Sequence
  Description of Artificial Sequence: Synthetic peptide
  Seed: PSGTTSVQVPTTEVISTAPVQMPTA (PMEL_HUMAN)
  Core: VISTAPVQM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTTEXISXAXVQXPTA

SEQ ID NO: 334226 - protein, 25 aa, Artificial Sequence
  Description of Artificial Sequence: Synthetic peptide
  Seed: PSGTTSVQVPTTEVISTAPVQMPTA (PMEL_HUMAN)
  Core: ISTAPVQMP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
PSGTTSVQVPTTEVXSTXPXQMXTA

SEQ ID NO: 334227 - protein, 15 aa, Artificial Sequence
  Description of Artificial Sequence: Synthetic peptide
  Seed: PSGYLAEADLSYTWD (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWD

SEQ ID NO: 334228 - protein, 15 aa, Artificial Sequence
  Description of Artificial Sequence: Synthetic peptide
  Seed: PSGYLAEADLSYTWD (PMEL_HUMAN)
  Core: LAEADLSYT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGYXAEXDXSYXWD

SEQ ID NO: 334229 - protein, 16 aa, Artificial Sequence
  Description of Artificial Sequence: Synthetic peptide
  Seed: PSGYLAEADLSYTWDF (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDF

SEQ ID NO: 334230 - protein, 16 aa, Artificial Sequence
  Description of Artificial Sequence: Synthetic peptide
  Seed: PSGYLAEADLSYTWDF (PMEL_HUMAN)
  Core: LAEADLSYT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGYXAEXDXSYXWDF

SEQ ID NO: 334231 - protein, 17 aa, Artificial Sequence
  Description of Artificial Sequence: Synthetic peptide
  Seed: PSGYLAEADLSYTWDFG (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFG

SEQ ID NO: 334232 - protein, 19 aa, Artificial Sequence
  Description of Artificial Sequence: Synthetic peptide
  Seed: PSGYLAEADLSYTWDFGDS (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDS

SEQ ID NO: 334233 - protein, 19 aa, Artificial Sequence
  Description of Artificial Sequence: Synthetic peptide
  Seed: PSGYLAEADLSYTWDFGDS (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXS

SEQ ID NO: 334234 - protein, 20 aa, Artificial Sequence
  Description of Artificial Sequence: Synthetic peptide
  Seed: PSGYLAEADLSYTWDFGDSS (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDSS

SEQ ID NO: 334235 - protein, 20 aa, Artificial Sequence
  Description of Artificial Sequence: Synthetic peptide
  Seed: PSGYLAEADLSYTWDFGDSS (PMEL_HUMAN)
  Core: LAEADLSYT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSGYXAEXDXSYXWDFGDSS

SEQ ID NO: 334236 - protein, 20 aa, Artificial Sequence
  Description of Artificial Sequence: Synthetic peptide
  Seed: PSGYLAEADLSYTWDFGDSS (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXSS

SEQ ID NO: 334237 - protein, 21 aa, Artificial Sequence
  Description of Artificial Sequence: Synthetic peptide
  Seed: PSGYLAEADLSYTWDFGDSSG (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDSSG

SEQ ID NO: 334238 - protein, 21 aa, Artificial Sequence
  Description of Artificial Sequence: Synthetic peptide
  Seed: PSGYLAEADLSYTWDFGDSSG (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXSSG

SEQ ID NO: 334239 - protein, 22 aa, Artificial Sequence
  Description of Artificial Sequence: Synthetic peptide
  Seed: PSGYLAEADLSYTWDFGDSSGT (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDSSGT

SEQ ID NO: 334240 - protein, 22 aa, Artificial Sequence
  Description of Artificial Sequence: Synthetic peptide
  Seed: PSGYLAEADLSYTWDFGDSSGT (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXSSGT

SEQ ID NO: 334241 - protein, 23 aa, Artificial Sequence
  Description of Artificial Sequence: Synthetic peptide
  Seed: PSGYLAEADLSYTWDFGDSSGTL (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDSSGTL

SEQ ID NO: 334242 - protein, 23 aa, Artificial Sequence
  Description of Artificial Sequence: Synthetic peptide
  Seed: PSGYLAEADLSYTWDFGDSSGTL (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXSSGTL

SEQ ID NO: 334243 - protein, 24 aa, Artificial Sequence
  Description of Artificial Sequence: Synthetic peptide
  Seed: PSGYLAEADLSYTWDFGDSSGTLI (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDSSGTLI

SEQ ID NO: 334244 - protein, 24 aa, Artificial Sequence
  Description of Artificial Sequence: Synthetic peptide
  Seed: PSGYLAEADLSYTWDFGDSSGTLI (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXSSGTLI

SEQ ID NO: 334245 - protein, 25 aa, Artificial Sequence
  Description of Artificial Sequence: Synthetic peptide
  Seed: PSGYLAEADLSYTWDFGDSSGTLIS (PMEL_HUMAN)
  Core: YLAEADLSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSGXLAXAXLSXTWDFGDSSGTLIS

SEQ ID NO: 334246 - protein, 25 aa, Artificial Sequence
  Description of Artificial Sequence: Synthetic peptide
  Seed: PSGYLAEADLSYTWDFGDSSGTLIS (PMEL_HUMAN)
  Core: LSYTWDFGD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PSGYLAEADXSYXWXFGXSSGTLIS

SEQ ID NO: 334247 - protein, 14 aa, Artificial Sequence
  Description of Artificial Sequence: Synthetic peptide
  Seed: PSPACQLVLHQILK (PMEL_HUMAN)
  Core: CQLVLHQIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSPAXQLXLXQIXK

SEQ ID NO: 334248 - protein, 15 aa, Artificial Sequence
  Description of Artificial Sequence: Synthetic peptide
  Seed: PSPACQLVLHQILKG (PMEL_HUMAN)
  Core: PACQLVLHQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PSXACXLXLHXILKG

SEQ ID NO: 334249 - protein, 15 aa, Artificial Sequence
  Description of Artificial Sequence: Synthetic peptide
  Seed: PSPACQLVLHQILKG (PMEL_HUMAN)
  Core: ACQLVLHQI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PSPXCQXVXHQXLKG

SEQ ID NO: 334250 - protein, 15 aa, Artificial Sequence
  Description of Artificial Sequence: Synthetic peptide
  Seed: PSPACQLVLHQILKG (PMEL_HUMAN)
  Core: CQLVLHQIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSPAXQLXLXQIXKG

SEQ ID NO: 334251 - protein, 15 aa, Artificial Sequence
  Description of Artificial Sequence: Synthetic peptide
  Seed: PSPACQLVLHQILKG (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKX

SEQ ID NO: 334252 - protein, 16 aa, Artificial Sequence
  Description of Artificial Sequence: Synthetic peptide
  Seed: PSPACQLVLHQILKGG (PMEL_HUMAN)
  Core: CQLVLHQIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PSPAXQLXLXQIXKGG

SEQ ID NO: 334253 - protein, 16 aa, Artificial Sequence
  Description of Artificial Sequence: Synthetic peptide
  Seed: PSPACQLVLHQILKGG (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXG

SEQ ID NO: 334254 - protein, 17 aa, Artificial Sequence
  Description of Artificial Sequence: Synthetic peptide
  Seed: PSPACQLVLHQILKGGS (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGS

SEQ ID NO: 334255 - protein, 18 aa, Artificial Sequence
  Description of Artificial Sequence: Synthetic peptide
  Seed: PSPACQLVLHQILKGGSG (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSG

SEQ ID NO: 334256 - protein, 18 aa, Artificial Sequence
  Description of Artificial Sequence: Synthetic peptide
  Seed: PSPACQLVLHQILKGGSG (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXG

SEQ ID NO: 334257 - protein, 19 aa, Artificial Sequence
  Description of Artificial Sequence: Synthetic peptide
  Seed: PSPACQLVLHQILKGGSGT (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGT

SEQ ID NO: 334258 - protein, 19 aa, Artificial Sequence
  Description of Artificial Sequence: Synthetic peptide
  Seed: PSPACQLVLHQILKGGSGT (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGT

SEQ ID NO: 334259 - protein, 20 aa, Artificial Sequence
  Description of Artificial Sequence: Synthetic peptide
  Seed: PSPACQLVLHQILKGGSGTY (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGTY

SEQ ID NO: 334260 - protein, 20 aa, Artificial Sequence
  Description of Artificial Sequence: Synthetic peptide
  Seed: PSPACQLVLHQILKGGSGTY (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGTY

SEQ ID NO: 334261 - protein, 21 aa, Artificial Sequence
  Description of Artificial Sequence: Synthetic peptide
  Seed: PSPACQLVLHQILKGGSGTYC (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGTYC

SEQ ID NO: 334262 - protein, 21 aa, Artificial Sequence
  Description of Artificial Sequence: Synthetic peptide
  Seed: PSPACQLVLHQILKGGSGTYC (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGTYC

SEQ ID NO: 334263 - protein, 22 aa, Artificial Sequence
  Description of Artificial Sequence: Synthetic peptide
  Seed: PSPACQLVLHQILKGGSGTYCL (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGTYCL

SEQ ID NO: 334264 - protein, 22 aa, Artificial Sequence
  Description of Artificial Sequence: Synthetic peptide
  Seed: PSPACQLVLHQILKGGSGTYCL (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGTYCL

SEQ ID NO: 334265 - protein, 23 aa, Artificial Sequence
  Description of Artificial Sequence: Synthetic peptide
  Seed: PSPACQLVLHQILKGGSGTYCLN (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGTYCLN

SEQ ID NO: 334266 - protein, 23 aa, Artificial Sequence
  Description of Artificial Sequence: Synthetic peptide
  Seed: PSPACQLVLHQILKGGSGTYCLN (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGTYCLN

SEQ ID NO: 334267 - protein, 24 aa, Artificial Sequence
  Description of Artificial Sequence: Synthetic peptide
  Seed: PSPACQLVLHQILKGGSGTYCLNV (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGTYCLNV

SEQ ID NO: 334268 - protein, 24 aa, Artificial Sequence
  Description of Artificial Sequence: Synthetic peptide
  Seed: PSPACQLVLHQILKGGSGTYCLNV (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGTYCLNV

SEQ ID NO: 334269 - protein, 25 aa, Artificial Sequence
  Description of Artificial Sequence: Synthetic peptide
  Seed: PSPACQLVLHQILKGGSGTYCLNVS (PMEL_HUMAN)
  Core: LVLHQILKG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQXVLXQXLKXGSGTYCLNVS

SEQ ID NO: 334270 - protein, 25 aa, Artificial Sequence
  Description of Artificial Sequence: Synthetic peptide
  Seed: PSPACQLVLHQILKGGSGTYCLNVS (PMEL_HUMAN)
  Core: LHQILKGGS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PSPACQLVXHQXLXGGXGTYCLNVS

SEQ ID NO: 334271 - protein, 16 aa, Artificial Sequence
  Description of Artificial Sequence: Synthetic peptide
  Seed: PTAEAPNTTAGQVPTT (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTX

SEQ ID NO: 334272 - protein, 17 aa, Artificial Sequence
  Description of Artificial Sequence: Synthetic peptide
  Seed: PTAEAPNTTAGQVPTTE (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXE

SEQ ID NO: 334273 - protein, 18 aa, Artificial Sequence
  Description of Artificial Sequence: Synthetic peptide
  Seed: PTAEAPNTTAGQVPTTEV (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEV

SEQ ID NO: 334274 - protein, 19 aa, Artificial Sequence
  Description of Artificial Sequence: Synthetic peptide
  Seed: PTAEAPNTTAGQVPTTEVV (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVV

SEQ ID NO: 334275 - protein, 20 aa, Artificial Sequence
  Description of Artificial Sequence: Synthetic peptide
  Seed: PTAEAPNTTAGQVPTTEVVG (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVVG

SEQ ID NO: 334276 - protein, 21 aa, Artificial Sequence
  Description of Artificial Sequence: Synthetic peptide
  Seed: PTAEAPNTTAGQVPTTEVVGT (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVVGT

SEQ ID NO: 334277 - protein, 22 aa, Artificial Sequence
  Description of Artificial Sequence: Synthetic peptide
  Seed: PTAEAPNTTAGQVPTTEVVGTT (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVVGTT

SEQ ID NO: 334278 - protein, 23 aa, Artificial Sequence
  Description of Artificial Sequence: Synthetic peptide
  Seed: PTAEAPNTTAGQVPTTEVVGTTP (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVVGTTP

SEQ ID NO: 334279 - protein, 24 aa, Artificial Sequence
  Description of Artificial Sequence: Synthetic peptide
  Seed: PTAEAPNTTAGQVPTTEVVGTTPG (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVVGTTPG

SEQ ID NO: 334280 - protein, 25 aa, Artificial Sequence
  Description of Artificial Sequence: Synthetic peptide
  Seed: PTAEAPNTTAGQVPTTEVVGTTPGQ (PMEL_HUMAN)
  Core: TTAGQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEAPNXTAXQXPTXEVVGTTPGQ

SEQ ID NO: 334281 - protein, 14 aa, Artificial Sequence
  Description of Artificial Sequence: Synthetic peptide
  Seed: PTAEPSGTTSVQVP (PMEL_HUMAN)
  Core: PSGTTSVQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXSGXTXVQXP

SEQ ID NO: 334282 - protein, 15 aa, Artificial Sequence
  Description of Artificial Sequence: Synthetic peptide
  Seed: PTAEPSGTTSVQVPT (PMEL_HUMAN)
  Core: PSGTTSVQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXSGXTXVQXPT

SEQ ID NO: 334283 - protein, 16 aa, Artificial Sequence
  Description of Artificial Sequence: Synthetic peptide
  Seed: PTAEPSGTTSVQVPTT (PMEL_HUMAN)
  Core: PSGTTSVQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXSGXTXVQXPTT

SEQ ID NO: 334284 - protein, 17 aa, Artificial Sequence
  Description of Artificial Sequence: Synthetic peptide
  Seed: PTAEPSGTTSVQVPTTE (PMEL_HUMAN)
  Core: PSGTTSVQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXSGXTXVQXPTTE

SEQ ID NO: 334285 - protein, 19 aa, Artificial Sequence
  Description of Artificial Sequence: Synthetic peptide
  Seed: PTAEPSGTTSVQVPTTEVI (PMEL_HUMAN)
  Core: PSGTTSVQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXSGXTXVQXPTTEVI

SEQ ID NO: 334286 - protein, 20 aa, Artificial Sequence
  Description of Artificial Sequence: Synthetic peptide
  Seed: PTAEPSGTTSVQVPTTEVIS (PMEL_HUMAN)
  Core: PSGTTSVQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXSGXTXVQXPTTEVIS

SEQ ID NO: 334287 - protein, 20 aa, Artificial Sequence
  Description of Artificial Sequence: Synthetic peptide
  Seed: PTAEPSGTTSVQVPTTEVIS (PMEL_HUMAN)
  Core: TTSVQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGXTSXQXPTXEVIS

SEQ ID NO: 334288 - protein, 21 aa, Artificial Sequence
  Description of Artificial Sequence: Synthetic peptide
  Seed: PTAEPSGTTSVQVPTTEVIST (PMEL_HUMAN)
  Core: TTSVQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGXTSXQXPTXEVIST

SEQ ID NO: 334289 - protein, 22 aa, Artificial Sequence
  Description of Artificial Sequence: Synthetic peptide
  Seed: PTAEPSGTTSVQVPTTEVISTA (PMEL_HUMAN)
  Core: TTSVQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGXTSXQXPTXEVISTA

SEQ ID NO: 334290 - protein, 23 aa, Artificial Sequence
  Description of Artificial Sequence: Synthetic peptide
  Seed: PTAEPSGTTSVQVPTTEVISTAP (PMEL_HUMAN)
  Core: TTSVQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGXTSXQXPTXEVISTAP

SEQ ID NO: 334291 - protein, 24 aa, Artificial Sequence
  Description of Artificial Sequence: Synthetic peptide
  Seed: PTAEPSGTTSVQVPTTEVISTAPV (PMEL_HUMAN)
  Core: TTSVQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGXTSXQXPTXEVISTAPV

SEQ ID NO: 334292 - protein, 25 aa, Artificial Sequence
  Description of Artificial Sequence: Synthetic peptide
  Seed: PTAEPSGTTSVQVPTTEVISTAPVQ (PMEL_HUMAN)
  Core: TTSVQVPTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGXTSXQXPTXEVISTAPVQ

SEQ ID NO: 334293 - protein, 25 aa, Artificial Sequence
  Description of Artificial Sequence: Synthetic peptide
  Seed: PTAEPSGTTSVQVPTTEVISTAPVQ (PMEL_HUMAN)
  Core: PTTEVISTA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PTAEPSGTTSVQVXTTXVXSTXPVQ

SEQ ID NO: 334294 - protein, 15 aa, Artificial Sequence
  Description of Artificial Sequence: Synthetic peptide
  Seed: PTAESTGMTPEKVPV (PMEL_HUMAN)
  Core: STGMTPEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXTGXTXEKXPV

SEQ ID NO: 334295 - protein, 20 aa, Artificial Sequence
  Description of Artificial Sequence: Synthetic peptide
  Seed: PTAESTGMTPEKVPVSEVMG (PMEL_HUMAN)
  Core: STGMTPEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXTGXTXEKXPVSEVMG

SEQ ID NO: 334296 - protein, 25 aa, Artificial Sequence
  Description of Artificial Sequence: Synthetic peptide
  Seed: PTAESTGMTPEKVPVSEVMGTTLAE (PMEL_HUMAN)
  Core: STGMTPEKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTAEXTGXTXEKXPVSEVMGTTLAE

SEQ ID NO: 334297 - protein, 13 aa, Artificial Sequence
  Description of Artificial Sequence: Synthetic peptide
  Seed: PTLIGANASFSIA (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIA

SEQ ID NO: 334298 - protein, 13 aa, Artificial Sequence
  Description of Artificial Sequence: Synthetic peptide
  Seed: PTLIGANASFSIA (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXA

SEQ ID NO: 334299 - protein, 14 aa, Artificial Sequence
  Description of Artificial Sequence: Synthetic peptide
  Seed: PTLIGANASFSIAL (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIAL

SEQ ID NO: 334300 - protein, 14 aa, Artificial Sequence
  Description of Artificial Sequence: Synthetic peptide
  Seed: PTLIGANASFSIAL (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXAL

SEQ ID NO: 334301 - protein, 15 aa, Artificial Sequence
  Description of Artificial Sequence: Synthetic peptide
  Seed: PTLIGANASFSIALN (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALN

SEQ ID NO: 334302 - protein, 15 aa, Artificial Sequence
  Description of Artificial Sequence: Synthetic peptide
  Seed: PTLIGANASFSIALN (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALN

SEQ ID NO: 334303 - protein, 16 aa, Artificial Sequence
  Description of Artificial Sequence: Synthetic peptide
  Seed: PTLIGANASFSIALNF (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNF

SEQ ID NO: 334304 - protein, 16 aa, Artificial Sequence
  Description of Artificial Sequence: Synthetic peptide
  Seed: PTLIGANASFSIALNF (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNF

SEQ ID NO: 334305 - protein, 16 aa, Artificial Sequence
  Description of Artificial Sequence: Synthetic peptide
  Seed: PTLIGANASFSIALNF (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXF

SEQ ID NO: 334306 - protein, 17 aa, Artificial Sequence
  Description of Artificial Sequence: Synthetic peptide
  Seed: PTLIGANASFSIALNFP (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFP

SEQ ID NO: 334307 - protein, 17 aa, Artificial Sequence
  Description of Artificial Sequence: Synthetic peptide
  Seed: PTLIGANASFSIALNFP (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFP

SEQ ID NO: 334308 - protein, 17 aa, Artificial Sequence
  Description of Artificial Sequence: Synthetic peptide
  Seed: PTLIGANASFSIALNFP (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFP

SEQ ID NO: 334309 - protein, 17 aa, Artificial Sequence
  Description of Artificial Sequence: Synthetic peptide
  Seed: PTLIGANASFSIALNFP (PMEL_HUMAN)
  Core: ASFSIALNF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANXSFXIXLNXP

SEQ ID NO: 334310 - protein, 18 aa, Artificial Sequence
  Description of Artificial Sequence: Synthetic peptide
  Seed: PTLIGANASFSIALNFPG (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPG

SEQ ID NO: 334311 - protein, 18 aa, Artificial Sequence
  Description of Artificial Sequence: Synthetic peptide
  Seed: PTLIGANASFSIALNFPG (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPG

SEQ ID NO: 334312 - protein, 18 aa, Artificial Sequence
  Description of Artificial Sequence: Synthetic peptide
  Seed: PTLIGANASFSIALNFPG (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPG

SEQ ID NO: 334313 - protein, 18 aa, Artificial Sequence
  Description of Artificial Sequence: Synthetic peptide
  Seed: PTLIGANASFSIALNFPG (PMEL_HUMAN)
  Core: ASFSIALNF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANXSFXIXLNXPG

SEQ ID NO: 334314 - protein, 18 aa, Artificial Sequence
  Description of Artificial Sequence: Synthetic peptide
  Seed: PTLIGANASFSIALNFPG (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPX

SEQ ID NO: 334315 - protein, 19 aa, Artificial Sequence
  Description of Artificial Sequence: Synthetic peptide
  Seed: PTLIGANASFSIALNFPGS (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPGS

SEQ ID NO: 334316 - protein, 19 aa, Artificial Sequence
  Description of Artificial Sequence: Synthetic peptide
  Seed: PTLIGANASFSIALNFPGS (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGS

SEQ ID NO: 334317 - protein, 19 aa, Artificial Sequence
  Description of Artificial Sequence: Synthetic peptide
  Seed: PTLIGANASFSIALNFPGS (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGS

SEQ ID NO: 334318 - protein, 19 aa, Artificial Sequence
  Description of Artificial Sequence: Synthetic peptide
  Seed: PTLIGANASFSIALNFPGS (PMEL_HUMAN)
  Core: ASFSIALNF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANXSFXIXLNXPGS

SEQ ID NO: 334319 - protein, 19 aa, Artificial Sequence
  Description of Artificial Sequence: Synthetic peptide
  Seed: PTLIGANASFSIALNFPGS (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXS

SEQ ID NO: 334320 - protein, 20 aa, Artificial Sequence
  Description of Artificial Sequence: Synthetic peptide
  Seed: PTLIGANASFSIALNFPGSQ (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPGSQ

SEQ ID NO: 334321 - protein, 20 aa, Artificial Sequence
  Description of Artificial Sequence: Synthetic peptide
  Seed: PTLIGANASFSIALNFPGSQ (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGSQ

SEQ ID NO: 334322 - protein, 20 aa, Artificial Sequence
  Description of Artificial Sequence: Synthetic peptide
  Seed: PTLIGANASFSIALNFPGSQ (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGSQ

SEQ ID NO: 334323 - protein, 20 aa, Artificial Sequence
  Description of Artificial Sequence: Synthetic peptide
  Seed: PTLIGANASFSIALNFPGSQ (PMEL_HUMAN)
  Core: ASFSIALNF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANXSFXIXLNXPGSQ

SEQ ID NO: 334324 - protein, 20 aa, Artificial Sequence
  Description of Artificial Sequence: Synthetic peptide
  Seed: PTLIGANASFSIALNFPGSQ (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXSQ

SEQ ID NO: 334325 - protein, 21 aa, Artificial Sequence
  Description of Artificial Sequence: Synthetic peptide
  Seed: PTLIGANASFSIALNFPGSQK (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPGSQK

SEQ ID NO: 334326 - protein, 21 aa, Artificial Sequence
  Description of Artificial Sequence: Synthetic peptide
  Seed: PTLIGANASFSIALNFPGSQK (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGSQK

SEQ ID NO: 334327 - protein, 21 aa, Artificial Sequence
  Description of Artificial Sequence: Synthetic peptide
  Seed: PTLIGANASFSIALNFPGSQK (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGSQK

SEQ ID NO: 334328 - protein, 21 aa, Artificial Sequence
  Description of Artificial Sequence: Synthetic peptide
  Seed: PTLIGANASFSIALNFPGSQK (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXSQK

SEQ ID NO: 334329 - protein, 22 aa, Artificial Sequence
  Description of Artificial Sequence: Synthetic peptide
  Seed: PTLIGANASFSIALNFPGSQKV (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPGSQKV

SEQ ID NO: 334330 - protein, 22 aa, Artificial Sequence
  Description of Artificial Sequence: Synthetic peptide
  Seed: PTLIGANASFSIALNFPGSQKV (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGSQKV

SEQ ID NO: 334331 - protein, 22 aa, Artificial Sequence
  Description of Artificial Sequence: Synthetic peptide
  Seed: PTLIGANASFSIALNFPGSQKV (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGSQKV

SEQ ID NO: 334332 - protein, 22 aa, Artificial Sequence
  Description of Artificial Sequence: Synthetic peptide
  Seed: PTLIGANASFSIALNFPGSQKV (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXSQKV

SEQ ID NO: 334333 - protein, 23 aa, Artificial Sequence
  Description of Artificial Sequence: Synthetic peptide
  Seed: PTLIGANASFSIALNFPGSQKVL (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPGSQKVL

SEQ ID NO: 334334 - protein, 23 aa, Artificial Sequence
  Description of Artificial Sequence: Synthetic peptide
  Seed: PTLIGANASFSIALNFPGSQKVL (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGSQKVL

SEQ ID NO: 334335 - protein, 23 aa, Artificial Sequence
  Description of Artificial Sequence: Synthetic peptide
  Seed: PTLIGANASFSIALNFPGSQKVL (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGSQKVL

SEQ ID NO: 334336 - protein, 23 aa, Artificial Sequence
  Description of Artificial Sequence: Synthetic peptide
  Seed: PTLIGANASFSIALNFPGSQKVL (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXSQKVL

SEQ ID NO: 334337 - protein, 24 aa, Artificial Sequence
  Description of Artificial Sequence: Synthetic peptide
  Seed: PTLIGANASFSIALNFPGSQKVLP (PMEL_HUMAN)
  Core: LIGANASFS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PTXIGXNXSFXIALNFPGSQKVLP

SEQ ID NO: 334338 - protein, 24 aa, Artificial Sequence
  Description of Artificial Sequence: Synthetic peptide
  Seed: PTLIGANASFSIALNFPGSQKVLP (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGSQKVLP

SEQ ID NO: 334339 - protein, 24 aa, Artificial Sequence
  Description of Artificial Sequence: Synthetic peptide
  Seed: PTLIGANASFSIALNFPGSQKVLP (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGSQKVLP

SEQ ID NO: 334340 - protein, 24 aa, Artificial Sequence
  Description of Artificial Sequence: Synthetic peptide
  Seed: PTLIGANASFSIALNFPGSQKVLP (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXSQKVLP

SEQ ID NO: 334341 - protein, 25 aa, Artificial Sequence
  Description of Artificial Sequence: Synthetic peptide
  Seed: PTLIGANASFSIALNFPGSQKVLPD (PMEL_HUMAN)
  Core: IGANASFSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTLXGAXAXFSXALNFPGSQKVLPD

SEQ ID NO: 334342 - protein, 25 aa, Artificial Sequence
  Description of Artificial Sequence: Synthetic peptide
  Seed: PTLIGANASFSIALNFPGSQKVLPD (PMEL_HUMAN)
  Core: NASFSIALN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGAXASXSXALXFPGSQKVLPD

SEQ ID NO: 334343 - protein, 25 aa, Artificial Sequence
  Description of Artificial Sequence: Synthetic peptide
  Seed: PTLIGANASFSIALNFPGSQKVLPD (PMEL_HUMAN)
  Core: FSIALNFPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASXSIXLXFPXSQKVLPD

SEQ ID NO: 334344 - protein, 25 aa, Artificial Sequence
  Description of Artificial Sequence: Synthetic peptide
  Seed: PTLIGANASFSIALNFPGSQKVLPD (PMEL_HUMAN)
  Core: LNFPGSQKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PTLIGANASFSIAXNFXGXQKXLPD

SEQ ID NO: 334345 - protein, 14 aa, Artificial Sequence
  Description of Artificial Sequence: Synthetic peptide
  Seed: PTTEVISTAPVQMP (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXP

SEQ ID NO: 334346 - protein, 15 aa, Artificial Sequence
  Description of Artificial Sequence: Synthetic peptide
  Seed: PTTEVISTAPVQMPT (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPT

SEQ ID NO: 334347 - protein, 16 aa, Artificial Sequence
  Description of Artificial Sequence: Synthetic peptide
  Seed: PTTEVISTAPVQMPTA (PMEL_HUMAN)
  Core: EVISTAPVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTTXVIXTXPVXMPTA

SEQ ID NO: 334348 - protein, 16 aa, Artificial Sequence
  Description of Artificial Sequence: Synthetic peptide
  Seed: PTTEVISTAPVQMPTA (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTA

SEQ ID NO: 334349 - protein, 16 aa, Artificial Sequence
  Description of Artificial Sequence: Synthetic peptide
  Seed: PTTEVISTAPVQMPTA (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTA

SEQ ID NO: 334350 - protein, 17 aa, Artificial Sequence
  Description of Artificial Sequence: Synthetic peptide
  Seed: PTTEVISTAPVQMPTAE (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAE

SEQ ID NO: 334351 - protein, 17 aa, Artificial Sequence
  Description of Artificial Sequence: Synthetic peptide
  Seed: PTTEVISTAPVQMPTAE (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAE

SEQ ID NO: 334352 - protein, 18 aa, Artificial Sequence
  Description of Artificial Sequence: Synthetic peptide
  Seed: PTTEVISTAPVQMPTAES (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAES

SEQ ID NO: 334353 - protein, 18 aa, Artificial Sequence
  Description of Artificial Sequence: Synthetic peptide
  Seed: PTTEVISTAPVQMPTAES (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAES

SEQ ID NO: 334354 - protein, 19 aa, Artificial Sequence
  Description of Artificial Sequence: Synthetic peptide
  Seed: PTTEVISTAPVQMPTAEST (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAEST

SEQ ID NO: 334355 - protein, 19 aa, Artificial Sequence
  Description of Artificial Sequence: Synthetic peptide
  Seed: PTTEVISTAPVQMPTAEST (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAEST

SEQ ID NO: 334356 - protein, 19 aa, Artificial Sequence
  Description of Artificial Sequence: Synthetic peptide
  Seed: PTTEVISTAPVQMPTAEST (PMEL_HUMAN)
  Core: TAPVQMPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVISXAPXQXPTXEST

SEQ ID NO: 334357 - protein, 20 aa, Artificial Sequence
  Description of Artificial Sequence: Synthetic peptide
  Seed: PTTEVISTAPVQMPTAESTG (PMEL_HUMAN)
  Core: EVISTAPVQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PTTXVIXTXPVXMPTAESTG

SEQ ID NO: 334358 - protein, 20 aa, Artificial Sequence
  Description of Artificial Sequence: Synthetic peptide
  Seed: PTTEVISTAPVQMPTAESTG (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAESTG

SEQ ID NO: 334359 - protein, 20 aa, Artificial Sequence
  Description of Artificial Sequence: Synthetic peptide
  Seed: PTTEVISTAPVQMPTAESTG (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAESTG

SEQ ID NO: 334360 - protein, 20 aa, Artificial Sequence
  Description of Artificial Sequence: Synthetic peptide
  Seed: PTTEVISTAPVQMPTAESTG (PMEL_HUMAN)
  Core: TAPVQMPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVISXAPXQXPTXESTG

SEQ ID NO: 334361 - protein, 20 aa, Artificial Sequence
  Description of Artificial Sequence: Synthetic peptide
  Seed: PTTEVISTAPVQMPTAESTG (PMEL_HUMAN)
  Core: PVQMPTAES
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVISTAXVQXPXAEXTG

SEQ ID NO: 334362 - protein, 21 aa, Artificial Sequence
  Description of Artificial Sequence: Synthetic peptide
  Seed: PTTEVISTAPVQMPTAESTGM (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAESTGM

SEQ ID NO: 334363 - protein, 21 aa, Artificial Sequence
  Description of Artificial Sequence: Synthetic peptide
  Seed: PTTEVISTAPVQMPTAESTGM (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAESTGM

SEQ ID NO: 334364 - protein, 22 aa, Artificial Sequence
  Description of Artificial Sequence: Synthetic peptide
  Seed: PTTEVISTAPVQMPTAESTGMT (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAESTGMT

SEQ ID NO: 334365 - protein, 22 aa, Artificial Sequence
  Description of Artificial Sequence: Synthetic peptide
  Seed: PTTEVISTAPVQMPTAESTGMT (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAESTGMT

SEQ ID NO: 334366 - protein, 23 aa, Artificial Sequence
  Description of Artificial Sequence: Synthetic peptide
  Seed: PTTEVISTAPVQMPTAESTGMTP (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAESTGMTP

SEQ ID NO: 334367 - protein, 23 aa, Artificial Sequence
  Description of Artificial Sequence: Synthetic peptide
  Seed: PTTEVISTAPVQMPTAESTGMTP (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAESTGMTP

SEQ ID NO: 334368 - protein, 24 aa, Artificial Sequence
  Description of Artificial Sequence: Synthetic peptide
  Seed: PTTEVISTAPVQMPTAESTGMTPE (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAESTGMTPE

SEQ ID NO: 334369 - protein, 24 aa, Artificial Sequence
  Description of Artificial Sequence: Synthetic peptide
  Seed: PTTEVISTAPVQMPTAESTGMTPE (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAESTGMTPE

SEQ ID NO: 334370 - protein, 25 aa, Artificial Sequence
  Description of Artificial Sequence: Synthetic peptide
  Seed: PTTEVISTAPVQMPTAESTGMTPEK (PMEL_HUMAN)
  Core: VISTAPVQM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXISXAXVQXPTAESTGMTPEK

SEQ ID NO: 334371 - protein, 25 aa, Artificial Sequence
  Description of Artificial Sequence: Synthetic peptide
  Seed: PTTEVISTAPVQMPTAESTGMTPEK (PMEL_HUMAN)
  Core: ISTAPVQMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVXSTXPXQMXTAESTGMTPEK

SEQ ID NO: 334372 - protein, 14 aa, Artificial Sequence
  Description of Artificial Sequence: Synthetic peptide
  Seed: PTTEVVGTTPGQAP (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXP

SEQ ID NO: 334373 - protein, 15 aa, Artificial Sequence
  Description of Artificial Sequence: Synthetic peptide
  Seed: PTTEVVGTTPGQAPT (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPT
